United States Patent 11,098,302 (IDENTIFICATION OF POLYNUCLEOTIDES ASSOCIATED WITH A SAMPLE) - sequence listing, part 77

SEQ ID NO: 265373 - DNA, 772 bp, Homo sapiens
  misc_feature: GYAE6OF01BZGI3.34.26.C04.1.454.CMB.1.raw
  modified_base (406)..(406): a, c, t, g, unknown or other
  misc_feature (406)..(406): n is a, c, g, or t
  modified_base (664)..(664): a, c, t, g, unknown or other
  misc_feature (664)..(664): n is a, c, g, or t
  modified_base (678)..(678): a, c, t, g, unknown or other
  misc_feature (678)..(678): n is a, c, g, or t
  modified_base (713)..(713): a, c, t, g, unknown or other
  misc_feature (713)..(713): n is a, c, g, or t
tcagtacacgtgatcacgaccggtgctcgatttagtctagcgactttgggtttggggctgggagaggagcccagcactagaggtcggcggttgtttccattcggtgatcagcactgaacacagagactcaccatggagtttggctggagcttgggtttttcctcgtttgctttacgttttaaaggaggttcgttccgaggttgtacgagggtgcaggtcgtgggtggacggtcggtggggggacgtcggtcggcccgacggccgttcgggggacctcccgtaggaccgtaccttccgttccgttggtcgaccgtacggtccggttacgtggtactttccctaaccgttcgaggtttacgtcaacggttcggacacgttcggtaccgtaccggttccgggggttccnccggtaacgggtcccgttaccggaaacggggtaccgtaaagggggccggttaggggtaggggtcggggtacggtacgttaaaggttttagttacggtagggttacgtaggtaaggttaacggtaacgttaacgtaactaaacttacgtacgtcgtaacgtaccggtacgttcggtaaggaacgggtcctaacgttcgacccgtactacggagtacgaacccgtactaacccgaactaccgacgtctaaggtctacganaactaagaccgtanacgtcagacggactacggagaccggaacgtacgtntttaacggtcgttaacgttcgtggaaccgtacggacggtaacgacgaccgccggtaccg

SEQ ID NO: 265374 - DNA, 897 bp, Homo sapiens
  misc_feature: GYAE6OF01C4JSH.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagtcttgggttttcctcgttgcttactttaagaggtgtccagtgtcaggtgcagcgtggtggaggtcggtaggggggaggcggtcggacccgaggtcccggtcggggacccgtccccgtaggaccgtaccttccttaccgtggcgcgacggtccggttcgtagggtacctttccgtaacccgtttacgaaaggttacggtacctaaaggttcggacctaaggttcggaccgtaaccgggtttcccggggacccgtccgaacgggtccctacccgggagggtaccgaagggggtcgtaggggtagggtcgggtcggtacgttaaggttagttaaccgttagggggttaataggttaaacggtaaggggttaaaacggtacggttaactaaaaccggttttaaacgaacggttggaaaccctaagggttaccccggttaaccgggtacgggtaaaccgggtacccggttaaccgtacccggtaaccccgttaccgtaaccgtaacgacggtaaacctaacgtaacccgaaacgaacgtaccgtacgtacgtaacgtacgaaccgtaaacgtaaacgtacccggtaaccgtaaccgtacgtaacggggaacgtaaccgggaaccgggaaccgggaaccgttaccgggtaaccgtttacggttaaccttaaacggtttaacccggtaaaggtaccggtaaaacgggttacgggtaaccgggttaagtaaacccccgttaaagtagtttaaaccgg

SEQ ID NO: 265375 - DNA, 682 bp, Homo sapiens
  misc_feature: GYAE6OF01B0IR6.34.26.C04.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (648)..(648): a, c, t, g, unknown or other
  misc_feature (648)..(648): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggctcaccatggtagtttgggctgagcgttgggttttcctcgttgcttactttaagaggtgtccagtgtcaggtgcagcgtggtggagtcgngggggagcgtcgaccngccgtggacctccgtgacgtactcgtctgcgcgngtcgtcgtggtcttccnccttcagtgtcgagtcggctagcgctaccggtcgggtcccgccgtacggtcctaccggacgggtacggaaggggtcgtacggggtaggttcggggtacggtaccgttaggtttaacgtaggtttagggttaagttaaggtaggtttaagggtaaacgttacgttaacgtaaacttaacgtacgttacgaccgtaacggtaccggttaccggtacgggaaccgggtcctaacgttacccgtacccgtcccgtaacgacgaaccacgtaacccgtaacgaaacacgactctatacgtcacgaataacgcacgtacgtcgacgtacgaccggtagaaccggcgtacgtacgtgttaacgtacgttacgngaccgtagacggtagaccgagcccgtactaccgg

SEQ ID NO: 265376 - DNA, 852 bp, Homo sapiens
  misc_feature: GYAE6OF01A013I.34.26.C04.1.454.CMB.1.raw
  modified_base (177)..(177): a, c, t, g, unknown or other
  misc_feature (177)..(177): n is a, c, g, or t
  modified_base (352)..(352): a, c, t, g, unknown or other
  misc_feature (352)..(352): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgttggtttcctcgttgcttcttttaagnggtgtccagtgtcgaggtgcagcgtggtggagtcggtgggggacgtcggtcggacccgaggccgttgggacctcccgtgactaccttcctcgtggtcgcacggtccgtcgtggtacttccgacctttcgaagttaggtaccagtcggacctagtcgaccgtccggtcgggtcccnccgaggtccctaccggtagggacggaacggggtcgtaggggacgggttggggtaggaccttaaggttagtaggttagggtatacgggtaatacgggtaaagttcggttaacctaaaacgtttacgtaaacggttcggaaacccggtacggtaaccccgggtttaccgggtaacgggtaaccggggtccccgtttaaccggttaaccccgtacccccggtttaaacgacccggtaaacggtaaaccgaaacccgttaaacccgtaaaccccggaaaagtaaccccggtacgtaaccgtttacggtacccttaccgttaaacggtaaaccttaaccgggtaaccgtaacccccggtaaacgttcccggaaacgggtacgggaaccccgggtaacccggaaacgggtacccggtaaaccgggtttacctttaggtaaccgtttagttcccgggtaggtaccgtaacgggacgtacggactaccgtaccggtaccgtaacccgg

SEQ ID NO: 265377 - DNA, 727 bp, Homo sapiens
  misc_feature: GYAE6OF01EH4HJ.34.26.C04.1.454.CMB.1.raw
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagcttgggttttcctgttgcttcttttaagaggtgtccagtgtcaggtgcagcgtgggtggagtcggtggggggaggcgtggccccaggcccgtggggacctccctgacgacctctccgtggtcgcaggtccgttcgtggtactttcccaaccctttcgaaggttagtccaagttcgggctaagttcggcctaccggtcggggttccccgaccgacgggccctaccgaggggaccggaaggggtcgtaggggaggttggggtggactaagtttagtagtggtatggagtaggtaaagtagtacaaatctagtcggacaggtaccgtcggtaggaacgggtcctacgttaccgtacccgtcctaccaaggaaccgaaccgtaaccctacccgaaacgaaccgtaccgtacgttacgtacgttaccgacgaacctaaagtacccggtaaccgaccggtacccggtaaggaccggaacgggtaacccgggaacggtaccggtaccgggttacttaacggtttagttacgttacggtacggttaggacgggtaacgaaggaaccgccgaacgcccgtaaccgg

SEQ ID NO: 265378 - DNA, 1199 bp, Homo sapiens
  misc_feature: GYAE6OF01EDPXL.34.26.C04.1.454.CMB.1.raw
  modified_base (184)..(184): a, c, t, g, unknown or other
  misc_feature (184)..(184): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttggctggagtcgttgggttttcctcgttgcttcgttttaagnggtgtccgagtgtcgaggtgcaggtcgttgggtggtacggttcgggtagggggggacggtccgggttacgggacccccagggtccccgggttacgggggtacccgtttacccgtgggaaccgtacctttccgtcccgtagggttcgaccgtaaccgggtccgtttcgtacggggttaaccttttcccctaacccgttttaggtaacggtttaaccgttacggtacgtttaacgggccccgttagtttaaccggggaccccgttaaccgggggtttcccgggggggtttacccccgacccccggttaagggggtccccccgttaaccccggggaaccgggggggtaaacggttaaaccggggggggtccggttacggggggtaacgggggtttaggggggtcccggggtaaccggttttaaaaggggttttaaaccggttaacggggtttacgggtttaaacgggttacggggttaaaaggtttaaacccgggggtttaaaaggggttttaaacgttaaccgggtttaaaaaaccgttacgggtttaaacggtaaaccggggttaccgtaaacccggggtttaaacccgggttttaccccggggttaacgggggtaaacccccgggggttaacccggttttaaacccggtttaccccccgttaaccccgggttaacccggtttaaccggaaaccggggtttaaacccggaaaaacccccgtaaaacccccgtttaaaaccccggaaaaaacccgggtacccggtttaaacccggttaaacggttttacccggttaaaccgtttaaacccgggtttaaccgtttaaaaacccggaaaaaccccggtttaccccggggtaaaaccccggtaaccccggggttttaaacccgggtaacccgggaaaacggggggtttaacccccggaaaaacccggggttaaccgggggtaaaaaccccccggtaacgggttttaaccggtttaaaaccgggtttttacggggttttaaaacccgtttt

SEQ ID NO: 265379 - DNA, 778 bp, Homo sapiens
  misc_feature: GYAE6OF01EYRZY.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttggggctgggagaggagcccagcactagaggtcggcggtgcttccattcggtgatcagcactgaacacagaggctcaccatggagtttgggctgagcttgggttttcctcggttgcttcttttaaaggnggttgtccaggtgtcgaggtgcagctggtggagtcgtgggggagcgtcggcccgagccgtggggaacctcccctaggactacctccgtccgtgtcggccaggccgttctcgggtactttcgaccctttacgaaggtaacgttctaacgtcgggactagtacggcgtaacccggtcgggggtacccccgacggaccggtacccgtacccggaacggggtaccgtaaacgggggggccttaaggggaagggttcgggggtacggaccgttaaggttacttaaggtaacgggtttagttaggtaacgttacggggaaacgttaacgtactaaacgtttaaaccggtattacggacgtaacgtaccggtccggtaacgggaaccgggtaccgtaacttcccgtaaccggtacctaccggtaacgaacgaacgtaacctaaacccgaacggaaacctacgggtctaccgtacgtctaaccgaacgtaactaaccggtaaccacgttacgacggtaagacccggacgtaaccggaacgtacggtacgttagtacgttaacgttaccgtggtacgaccgggagaagaccgtaagcggtaacccg

SEQ ID NO: 265380 - DNA, 848 bp, Homo sapiens
  misc_feature: GYAE6OF01BNV4R.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttggctgagtcgttcgggttttcctcgttgcttacgttttaagaggttcgtccgagttcgtcgaggtgcgagtcgtggtaggtaggtcggtggggggacggtccggtccggacccgacgggtccggtacggggtaccctcccgtaggacgtccttccgtccgtgtacgcgtagccgttcgtcggtacttccgtaccgttcgacggttaagtctacgtcggacagttccggaccgtcggtcccggggtcccaccggtacgtacccgtacggaccgggacgggtaacggggtcggtaggggttagggtacggggtaccggacggtttaaggtttaaggttaggtagggttaagtaggtaagggtttaacgggaaaagttttccgaaacgttaacgttaacgtacgtagacgtacgggtaccgtacgggtacgggtaaacggccttacgttcccgtaccgtacgtacgaacgtaaacgacccaacgtaccgaaagtaacccgacgttacgtagttacgaactccgtaagaaccgtacccgggtaaccgttaccggacgttacggggaaaccggtcccggaaacgggtacgtaaacccccggttacgttaacggttaccgtttacggtaaccggttttagggccgtaaacgggtacgggaaaaccgttcggaaaaccgtttcccgaccggtaacccccggttaaaccgggg

SEQ ID NO: 265381 - DNA, 875 bp, Homo sapiens
  misc_feature: GYAE6OF01AZ43U.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttcttttaagaggtgtccagttgtcaggtgcagcgtgggtggagtcgtgggggagcggtggcccagccgtgggaccgtccgtggacgtactcctccgttggtcgccgtaggccgttcgtacggttactttcctaacccgtttacgaggttacgtacgtagtcggtaccagttcgtccgtaacggttcgggtccccgtaccgagggtcccgttacccggagggaccgggtaaacgggggtcgttacgggggaacggggtttcggggtacggtaaccggtttaaaggtttaacgtagggtttacgggttaggtaaggtaagggttaggtaaaaggttacgtaaacgtaaagtttaaccgtaggtacgtacccggtaaacgttcccggtaccgggtaacgggtaacgggtacccgtttaacgttacccggttaacccgttaccgtaccggaaacgtaaccgtaaaccgtaacccgtaaacccgaaaccggtaaccgtaaccggtttcttaaccgtaacggttcctaaaccggttaaacgtaaaccgttacccgggaaacgttacccggaccgggttaagaacccggggtaacccggtacgggtaaccgaacgggttaccgtaaccggttaacgttaggttaacgtttacggacggttaccggaaacgtcgggaaacgtacgggaaccgtaacccggcgtttaacccggg

SEQ ID NO: 265382 - DNA, 833 bp, Homo sapiens
  misc_feature: GYAE6OF01AGH3F.34.26.C04.1.454.CMB.1.raw
  modified_base (689)..(689): a, c, t, g, unknown or other
  misc_feature (689)..(689): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttacgttttaagaggtcgtccagtgtcaggtgcgacgtcgtgggtggaggtcggtgggggaggccgtcggccccgaggcccgtgggacctcccgtagacgtcctcctccgtggtcgactacggtcgttaccgtaggtactttcccgtaacctttcgaacggttactcgagtcggtacgtattcggccgtaccggtcggggtaccccgaccgacgggtacccgtacccggaagggacccgggaaaggggggtccgttaggggtacggggttaggggtacggtaacgtttaaggtttaacgtaggtttagggttaactagggtaaaggttacgggtaaattaaggtttaactaaaacgtttactaacgtccgggtaacgaaccgggttaaccgttccgggtaaacgggaaccgggtacccgttaacgtttccccggtaacccggttacccgtaaccggaacggtaaacgaaacccgtaaacccgtaaacccgaaaccgaaccgtaacggttacttacgttaanacttaacggaaactaacggaccgtaccgaccgtaccgtaggaaccgtacgaacccgggacgaccggtacgtacgttaacgttaggttaacgttcggtaggtaacggaggtaaacggaacggaaccaagtcccggacgtaaccgg

SEQ ID NO: 265383 - DNA, 838 bp, Homo sapiens
  misc_feature: GYAE6OF01DA575.34.26.C04.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagtacacgtgatcacgaccggtgctcgatttagtctagcgactttgggtttggggctgggagaggagcccagcaactagaggtcggcggtgtttccattcggtgatcagcactgaacacagaggactcaccagtggagttgggctagagtcttagggttttcctcggttagcgtttacgttttaaaggnggtcgtccagttcgtcacggtncaggcgtgggngtagtcggtagggggncggtacggcccaggtccgtaggggaccttacccgtggaactccttcgtacgtgtcgaccgtagtaccgtacgtcggactttaccgtaacccgttgtaaacggtcttaacgtcgtacggtagaacgttcgtaccgtaccggtcgggtcccgaaccgtcgggacctacggaacgggtacggaaggggttacgcgggtaggttaggggctactaaggttattaggtaggtactacggtagtaacgtaaggtaactacgtaaattccgtaaggctaacgtacgtacgtacggtacgtaaacggtccgtacgttaacgaccccgttacgaactaacgggtaacctaaaccgaccgttaaacccgtaaacggaaaccggtactttacccgtaacgttaaaccgttaccggtaaaccgacgtttaaaaccggccggtaaaccgttaaccgggacgtttaaggaaacccgggacggaaaccccgggtttaacgaacccgggtaaaccgtgtttaaaccggtttaggttaaacccgttaccgggttagaaccggaaacggtttcccggaaaaagccgggttaaacaaacgggtccccttaaacgggg

SEQ ID NO: 265384 - DNA, 827 bp, Homo sapiens
  misc_feature: GYAE6OF01EZU76.34.26.C04.1.454.CMB.1.raw
  modified_base (286)..(286): a, c, t, g, unknown or other
  misc_feature (286)..(286): n is a, c, g, or t
tcagtacacgtgatcacgaccggtgctcgatttagtctagcgactttgggtttggggctgggagaggagcccagcactagaggtcggcggtgtttccattcggtgatcagcacgtgaacacagaggactcaccatggagtttgggctgagcttgggtttttcctcgttgcttcgttttaagaggtcgtccagttgtctaggtgcaggtcgtgggtggtaggtcggtggggggacgccggtcggcccaggtccgtggggacctcccgtgacgtctctcgtgtcgacnggcgtctggtacttccacgttcgagttagtccgagttcggctaagttcggacctacgggtccgggtacccgacggacggtcccgtaccggaccgggacggggtaacggggtcggtaggggtacgggttgggggtacggtaccgttaagggtttaagtaggtttagggtaaagttaggtaacgggttaaggtaaaggttaaccgtaacgtaaaacgttcttaacggcggtaaccgtaacggttacccgggttaccggttaacgggaaccggtaccgttacgtaccccggttacgtacccgtaaccgaagttaaccaaccgtaaccgtaaccgaaacgtaaccgtaccttaggttaacctcgttaaccgcggtaaacgaaccgttaccggaacgttacccgtaggaacgggtaccgtaacccgggtacggaacccggttacggtaccgtttaaacgttacggttaacctttaagggttcggtacgggtaccgggaaatacggggtacccgaaacggtaacctcccggtaacgttaacccgggg

SEQ ID NO: 265385 - DNA, 797 bp, Homo sapiens
  misc_feature: GYAE6OF01CPYZQ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacataggactcacagtggagttgggctgagtcttgggttttcctcgttgtcttacgtttaagaggtgtccaggtgtcgaggtgcagcgtgggtaggagtcggtgggggacggcgtcggcccgacgtccggtcgggtaccgtccgtaggaccgtacttcctcggtgtcgcgagtccgttcgtgtacgttcctaccttacgagttacgtcctaagtcggactacgtcgaccgtaccggttcggggacccgacggccggacctaccgggtaagggaccgggtaaggggtaccggttaggggacgggtacggggttccggtaacgtttaggttaacgtaggttacggttagacgtaaggtacgggtaacgtagtaaactacgttatacgtacgaccgtacggtaccgtacgggtaaggtacccggacgttaccctaccggtaaccgtccgtaacgaagtaacccgtaactaaacccgtaccgaaacgtaaacgcgtacgttacgtaacttacggtaactaaaccgaacgtttacccgacgtaccccgggtaagtaaccgggtacggaacccggtaaccgggacggtaaacgggaccgttacgtaacgtttacggtacgttaccgggtagtaacgggacggtaaacggaccgtagaacccggtaaacgtcccgggttaaaccgg

SEQ ID NO: 265386 - DNA, 622 bp, Homo sapiens
  misc_feature: GYAE6OF01E3WGS.34.26.C04.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttctttttaagaggtgtccagtgtcaggtgcagctgggtggagtcgtgggggaggcgtggccccaggcccgtggggacctccctggacgtacctcctcctgtgcagtcgtctggacttccaccttnagtagtcatggcatgctacgtcgggtccnccgaggcctcgagggacaaggggctagggaggtgggtgctagttatagtgggtatgagtaggaagtagtactaaagttactagtgactaaggtacctccgggtagggaacgggtccgtattcccgaccgttcaccgagaacgacctaactaccccaaagaaccacgtacgttagtactcgtagaacctaacgtcgaacctacggtacctaggacgtaccggaccgacgggaccgacccggttatacgttaggttaacttacggtgtacgggcgtaagacggaagccgaccgccgtaacg

SEQ ID NO: 265387 - DNA, 822 bp, Homo sapiens
  misc_feature: GYAE6OF01DZRK5.34.26.C04.1.454.CMB.1.raw
  modified_base (393)..(393): a, c, t, g, unknown or other
  misc_feature (393)..(393): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttcgggctgacgtcttcggggtttttcctcgtttagcctttacgttttaaaggcggttcgtacctagtgtccgaaggtcgccgagtcgtgggtaggacggttcgggtaggggggacgtccggtcggaccccgaggtaccccggttcggggacccttaccccgtggtaaccgtacccttccgttcccggtggtacgtccgacggtccggttcgttacggtaacttttccccgaacctttgaaggttacgtccgngttcggctaattcgggacctacggggtcgggtcccacggtcggccctacggacggggttacgaacggggtctaggggtacggtggggtccgagttaagtttacgagttgggtagtagtaacggtaggtaaaccgttgtaactaactacgtagtagaccgtaacgtccgtaccgggtaacggtaacccggtccgttacttaacccgtacccgttccgtaaacgacggaaaccctaaccgaacccttaaccggaacccgaacaccccgttagttaagtaccctagtaaccgaacgtaccaccgggtaaccaccgacctagggaccgaccggtaaccggaaacgcccgttaggtaacgttctttacggtaacgtttacgtcggaacggtaacgaaacggttacgaaccgtacgtacccgtaaccccggtagg

SEQ ID NO: 265388 - DNA, 769 bp, Homo sapiens
  misc_feature: GYAE6OF01B7VHK.34.26.C04.1.454.CMB.1.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggttgtccagtgtcaggtgcagctggtggagtcggtggggagcgtggcccagccgtgggacctcccngacgactctcctggtncgaggcgtctggtacttccaccttnagtgtcagtggcatcgactaccgtgggtcccnccgacggcctaccgagggaccgaaggggtctagggacggttggggtcggctaaggtttataggtaggttacgtaggtaagtagggtaaacgttagtaactaaagttacgtagtcggaaccttacggtaaccgttccgggtaacgggtaaccggggtacccttaacgtttacccgaaccccgtttacgtaacccgaaaggtaaccgtaaccaaaccgttaaccccgaaaacgtaaacccaccggtacgttacgttaaccttacgtaactaaccgaaacgtcccggtaaaccgtacggaccgttaaggaaccggaaccggtacccgggaaacgggtaccccgtaaacggtacccggttaaagtttaccgggtaaagttttccggtacggttaaacggaacccggtaagggtaccggaaaaccgacggtaaaccccggtccgttaaacccgggg

SEQ ID NO: 265389 - DNA, 879 bp, Homo sapiens
  misc_feature: GYAE6OF01DYX9Y.34.26.C04.1.454.CMB.1.raw
  modified_base (506)..(506): a, c, t, g, unknown or other
  misc_feature (506)..(506): n is a, c, g, or t
tcagtacacgtgatcacgaccggtgctcgatttagtctagcgactttgggtttggggctgggagaggagcccagcactagaggtcggcggtgtttccattcggtgatcagccactgaacacaggaggacctcaccagtggtagtttgggctggagtcgttcgggttttcctcggttcgtcttacgttttaagaggtgtccgtagtgtcgaggtcgcaggtcgtgggtcggtacggttcgggtaggggggcggccggttcgggaccccgtagggccccggtcgggggtacctccccgtaggaaccgtccttccgttcccgtggtccgtacgtacggttcccggttagacggttacttaccctaccgttcgtaaaggttaccgtcgtagtcggctaggtcgaaccgtcggtcggtcctaccgcgtccgtaccgaggaggaccgggtgtagggtcgggtgggtacgacttagttagtaggtgtagtggtaagttacggtaaacggttanacgttaaaacttggagttaacggacccggtttaagtcccggttacccggaagggttacccgggtaaccttaccggtttacccgtacccggtacccgttaaacggaacggtaaccctaaaccggttaaacccgaaccccgtaaacggtaccgtaccggttaacgtttacgtaacgttaccgtaacgtaaaccaaccggtaaccgttacccggaccgttaacgggaacccggaggaaacccgggtaaccggtaaccgaaacccggtttacgtaaacggttttaaaccgtcgggtttaaaccgttcgggtaaccggttaaggggaaaccgagtaaccggggaaaactttcccgggaaacccgtcccggtaaacggg

SEQ ID NO: 265390 - DNA, 784 bp, Homo sapiens
  misc_feature: GYAE6OF01AGMW8.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagtctgggttttcctcgttgcttcttttaagnggtgtccgagtgtcgaggtgcagtcgtgggtaggaggttcggtgggggtagccggtcggacccgacgccggttacggggaccgttccctggaaccggtcttccgttaccgtggtcggcacgggtccgttacggtgggttacttaccgtaccgttcgtaggttaccgtacgtagtcgggtacctaggtcgcgtacccgggtcggggtcccgacccgtacgggtccgtacccggtaacgggacgtaaggggtccggttaggggtacgggtggggtcgtacggttaggttacgttaagttgggtatcggaagtagggttaacggtaatacgtaaacgtagttagtaccggacgtaacgggtacgttaaccggtaacgggtaaccggtacggttaaccgtcccgttacccgtacgtaccggtaaacggtaaccaacggtaaccctaccggaaacgtaccgtaaccgactttcgacgttaccgaacgaacgttacggactaaccgtacccggacgtaacggacgtaaccgggacggttaacgaaccgtacgtacgtacgtttacgacttcggtagaggacggtaagagaaccgaagtaccgcgtaaacggg

SEQ ID NO: 265391 - DNA, 744 bp, Homo sapiens
  misc_feature: GYAE6OF01AP15V.34.26.C04.1.454.CMB.1.raw
  modified_base (233)..(233): a, c, t, g, unknown or other
  misc_feature (233)..(233): n is a, c, g, or t
  modified_base (268)..(268): a, c, t, g, unknown or other
  misc_feature (268)..(268): n is a, c, g, or t
  modified_base (435)..(435): a, c, t, g, unknown or other
  misc_feature (435)..(435): n is a, c, g, or t
  modified_base (634)..(634): a, c, t, g, unknown or other
  misc_feature (634)..(634): n is a, c, g, or t
  modified_base (682)..(682): a, c, t, g, unknown or other
  misc_feature (682)..(682): n is a, c, g, or t
  modified_base (708)..(708): a, c, t, g, unknown or other
  misc_feature (708)..(708): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgtgggttttcctcggttgcttcttttaaaggaggtgtcctagtgtcgaggtgcagcgtgggtcggtaggtcggtggggggngtcggtcggcccaggccgtcggggaccgttcccgngaacgccttcgtcctggtcgacgacggtccgtcgttaggtactttaccctaccgtttacgtaaggttcgttaccgagttcgggccaagttcgccgtaacggtcggggtccccgccgacgggccctaccgggagggacggaacggggtcggtagggtaggttcggggngtacgtaggttaataacggtggtagtagtaggttacgggtaagtaacgtaacgtaacgttaactagtgtaacgtacggtacccgtcggtaacgggaaaccgggtacctaccgtttacccgacccgtaccgtaaccgagtaaaccggaacctaaccgtaacccgaaacgaaccgtacgtacttacggtacctacggtaanaaaccctaggtaaccgtacgaacgtgaccggaagtccgacgtaaccgngaccggtatgtagttaagtcgaaggnaaccgggtaggaccgtaagaccgtcgtaccgtaagg

SEQ ID NO: 265392 - DNA, 765 bp, Homo sapiens
  misc_feature: GYAE6OF01B38RC.34.26.C04.1.454.CMB.1.raw
  modified_base (286)..(286): a, c, t, g, unknown or other
  misc_feature (286)..(286): n is a, c, g, or t
  modified_base (316)..(316): a, c, t, g, unknown or other
  misc_feature (316)..(316): n is a, c, g, or t
  modified_base (437)..(437): a, c, t, g, unknown or other
  misc_feature (437)..(437): n is a, c, g, or t
  modified_base (739)..(739): a, c, t, g, unknown or other
  misc_feature (739)..(739): n is a, c, g, or t
tcagtacacgtgatcacgaccggtgctcgatttagtctagcgactttgggtttggggctgggagaggagcccagcactagaggtcggcggtgtttccagttcggtgatcagcactgaacacagaggactcacagtggtagtttggctgagtcgttgggttttcctgttgccttagttttaaggaggtgtccaggtgtcgaggtgcgagtcggtggtggaggtggtgggggacgcggtcggacccgacggtccgtcgggtaccgtcccgtgacgtacctccgtccgngtcgacgcgtcgtctggtacttcgaccttnaagttgtctagtgctagtcgcgtaccggtcggtcccacgcggtaccgtaccggagggaccggtaacgggtggttacggggtgggtacggtcggtacgttaggtttagtaacggtgttaagnggtaaacgtaaggaacggttaagtacgtaataaccgttggacgtacgaacgttacgttacggaacgggtaccggtaccgttaacttcccggtaaccgttaccgaacgaacgaaccgtaaccctaaaccgtaacccgtaaaacgtacccgtaacgttaccgttacggtaacttccgtaaaccggaaaccgttaacgacccgtaaccgtaacggtaccgaaccgggacggaacccgggtaacggaacgtaaccccgtagttaccgttagttacgtaacggtttggtacggaagtaggtaaacgnggaaccgacgttccgaacgtaccggg

SEQ ID NO: 265393 - DNA, 646 bp, Homo sapiens
  misc_feature: GYAE6OF01DET9B.34.26.C04.1.454.CMB.1.raw
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (325)..(325): a, c, t, g, unknown or other
  misc_feature (325)..(325): n is a, c, g, or t
  modified_base (386)..(386): a, c, t, g, unknown or other
  misc_feature (386)..(386): n is a, c, g, or t
  modified_base (415)..(415): a, c, t, g, unknown or other
  misc_feature (415)..(415): n is a, c, g, or t
  modified_base (534)..(534): a, c, t, g, unknown or other
  misc_feature (534)..(534): n is a, c, g, or t
  modified_base (567)..(567): a, c, t, g, unknown or other
  misc_feature (567)..(567): n is a, c, g, or t
  modified_base (587)..(587): a, c, t, g, unknown or other
  misc_feature (587)..(587): n is a, c, g, or t
  modified_base (630)..(630): a, c, t, g, unknown or other
  misc_feature (630)..(630): n is a, c, g, or t
tcagtacacgtgatcacgaccggtgctcgatttagtctagcgactttgggtttgggctgggagaggagcccagcactagaggtcggcggtgtttccagttcggtgatcagcactgaacacagagactcacagtggtagtttggctggagtcgttcggtttcgtcgttgcttacgttaagnggtctcagtgtcaggtgcagcgtggtggaggtggtgggggcgcgccggaccgnggtcggtacggcctccgagacgtcctcacgtgacgcgcgngttacgtgtactaccngttcaagtgtcagtcgactgtcgacgcgtccggccncgtacgcctcggaggacgtacgggtctagggtggtcggtacgcgtaagttatgaggttagngtaacggaggtaatgtaagtaacttcgancgtacgtaccgttcggtaaccggtacgggtacggttaaccgtccgttaaccgtacccggttaccgacgtaacgaaccacgttaaccaacgtaacctaacgcgtactagtaacctcgtanaacttacgacgtaccgacgcggacgacgaccgngaccggtattcccgaagttntaaccggtttgacggtcggtaaaggagaacgtacggtaaaccncgaccgtccgtacggg

SEQ ID NO: 265394 - DNA, 782 bp, Homo sapiens
  misc_feature: GYAE6OF01ESA7N.34.26.C04.1.454.CMB.1.raw
  modified_base (721)..(721): a, c, t, g, unknown or other
  misc_feature (721)..(721): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccgagtgtcaggtgcagcgtggtggagtcgtgggggagcggtggcccagcccgtgggaccgtcccgtgacgactctccgtgtcgcgaggtcgttcgtaggtacttccaccgtttcgaggttacgtacaagtcggcacgtgacccgtacgttccggggtcccgccgaacgggtccctacccggagggaccgggtaacgggggcttggggaagggttgggggtcggaacgttaaggggtttaactaggttagtacgtaggtagtacgggaaaagttacgtactaaaacgttaactagtacggtacgtaacggaaccgtttcggaacgggtaaacccgggcttaaaccggtttacccggtaacccccgttacgtaaccgaacgggtaaacccgtaaaccgttaaaccctaaacccccggaaaacggaaacccggtacgtaccttaacgggtaaccttaccggtagtaaaaccgaacgttaccgaacccgtacgttacccggaggtaacgggacccgtaacggaaacggtaccgaccggttntaaacgttaggttaccttaaggtcggacgtaacggaggagtaacgaccctgaccccgtagg

SEQ ID NO: 265395 - DNA, 718 bp, Homo sapiens
  misc_feature: GYAE6OF01D6G0E.34.26.C04.1.454.CMB.1.raw
  modified_base (144)..(144): a, c, t, g, unknown or other
  misc_feature (144)..(144): n is a, c, g, or t
  modified_base (278)..(278): a, c, t, g, unknown or other
  misc_feature (278)..(278): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggntgagcttgggttttccctcgttgcttacttttaaggaggtgtccaagtgtcgaggtgcagcgtaggtggacgtcggtggggggagcgtcggcccagcccgtgggacctccctgacgtcctctccgtagtcgacngtcgtctggacttcaccgttcagtagtcatggctatgctacgtcggggtcccacggcggtcctccggagggaccggaaggggtccgtaggggaggttcggggtcggtaccgttaaggtttataggttaggtaagttggaaggttagggtaaaggttacgtagtaatacgttatacgcgtaacgtaccgtcggttaagggaaccgggtccgtacgttacccgtacccgtcctaaccggaagtaaccggaacctaaaccgtaaccccggaaacgtaaccgtaccggttacgttacgtaccgttaacagtaaccaaaacgtcccgtaaccgaacgccggtaacgaggtaacccggaaccggaagtaacccggacgttcgtaacgttagttaacgttcgaggtacgaccggtaaggtacgaacggaacgcccggcctaaccggg

SEQ ID NO: 265396 - DNA, 789 bp, Homo sapiens
  misc_feature: GYAE6OF01AC6T4.34.26.C04.1.454.CMB.1.raw
  modified_base (500)..(500): a, c, t, g, unknown or other
  misc_feature (500)..(500): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctgagtcgttcgggttttcctcggttcgcttacttttaaggaggttcgtccgtagttgttcgaggtgcgagcgtggtggacgtcggtgggggacgcgtcgcccgtaggcccgtgggcctccgtagtacgaccttccgtccgtgtagactaggtccgttgtcggtacttccctaaccgttgtacgtaggtaccaggttcggactacgttgacctccggtacgggcccgaccgttaggccctacggagggaacggtaccgggtgtggggtagggtcggtccggaatttaaggttacgttaggaaccggtttggaactaggggttagaaaggttaccgtactaaacgttaggtacgngaaccgtaccgtacggttaccgtaggtaaccggaccgttacgtcccgttaacccgtacgttaacccgaacgtaaccgaaacgttaccgaaccgaaccgaacgtaccgtacgttagttaaccgtacgtacgtaaccgtaaccgtacgtaacccgtaccggaccgttaacgggaacccgtaccggtaaaccggccggttaaacccggtagtaccggtttacgtaccggtttagtcggttacggaaggtacggtaaacggacgtaaaccggccgttaacgcccggttaccgg

SEQ ID NO: 265397 - DNA, 789 bp, Homo sapiens
  misc_feature: GYAE6OF01A7LM3.34.26.C04.1.454.CMB.1.raw
tcagtacacgtgatcacgaccggtgctcgatttagtctagcgacttttgggtttggggctgggagaggagcccagcactagaggtcggcggttgtttccgattcggtgatcagcactgaacacagaggactcaccagtggagtttggctggagtcgttgggttttcctgtttgcttacgttttaaggaggttcgtcctagttgtcgaggtgcgagcgtgggtggagtcggtggggagccgtcggccgagccgtgggaccgtccgtgacgtctcgtcgtagtcgcgtaggtcgttcaggttacttcctaccgtttgaggttacgtctagtcggtacagttcggaccgtacgggtaccgggtcccgaccggaacgggtcctacccgggagggaccggtaaggggcgtttagggacggggttcgggtaggtacgttaaggtttagtaggtttcggagttaggaacgttaaggtaaacgttacggtacttaaagtacgttgacggacctaacgggttacccgtaggtaacggtaccggtaccgttacgtacccgttaccccggtaaccgttaccgaaacgtaaaccgaaccgtaaaccgtaaccccgtaaagtaaccgccgtaacgttacgtaacgtacgacgttaacgaacggtaccgaacgttccgtaacgtaacggacccgaaccgggtaccggaaccggtacgtaacccggttaagtcggttacggttacgtttacggtacgggacgtacggtaaacgacggaaaccgtcgtaaccggaccgttaacgg

SEQ ID NO: 265398 - DNA, 824 bp, Homo sapiens
  misc_feature: GYAE6OF01CTC34.34.26.C04.1.454.CMB.1.raw
  modified_base (184)..(184): a, c, t, g, unknown or other
  misc_feature (184)..(184): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggagtttggctgagtcttgggttttcctgttgtacttacgttttaaaggnggttcgtaccaggtgtcgaaggtgctaggtcgtgggtggacggttcggtagggggacgtcggtacggacccgacggtccggtacggggtacccttcccgtaggaacgtcctccgttccgtaggtcgacgacggtccgttccgtaggtaccttcctaaccgtttcgaagttacgtccgaagtggacctagtcgccgtacggtcgggcccgaccgtacgtaccgtaccggagggtaccggaacggggtctaggggtacggtaccggggtagtaccgttaaaggtttacgttaaggttacgggtattaggtaagggttacggtaaaacggttacgttaaaccaaagtttaccgtaaggttccggtaaccgtaaggttacccggtacgggttaaccgggacgggttacccgtaacgtttacccgtaaccggttccgttaaccggaacgtaaccggtaacaaacccggtaacccgaaacgaaccgtccgtacgttacgttacacgttacaaacgtacgtacgacctacggactaagggacgtacggaaccggtacggtaaacccggtggtaaccgttacgttagttaacgtttacgaagggttcgaaacgggttagaacgacgtaaccgacggtcccgtaacggg

SEQ ID NO: 265399 - DNA, 769 bp, Homo sapiens
  misc_feature: GYAE6OF01AMJZ3.34.26.C04.1.454.CMB.1.raw
  modified_base (118)..(118): a, c, t, g, unknown or other
  misc_feature (118)..(118): n is a, c, g, or t
  modified_base (185)..(185): a, c, t, g, unknown or other
  misc_feature (185)..(185): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagtacacgtgatcacgaccggtgctcgatttagtctagcgactttgggtttgggctgggagaggagcccagcactagaggtcggcggtgtttccattcggtgatcagcactgaacncagaggactcaccatggagtttgggctgagtcttggggttttcctggtttcgcttcgttttaaaggnggttctccgagttcgtcagggtcacaggcgtggtggaggtcggtgggggagcgtcggcccagccggtgggacctccgtgactcctctcgtgtcgcagcgtcnggtacttccnccttnaggtacgtcagtggactatcgcctacggtcgggtcccaccggtacggccttaccggagggaccggtacgggggctggggtaaggtcgggggttacgacgttaaggtttaaggtaggttaggtaacgtacgggtaagttagggtaaaacttagggttaacctaaatttacgtaagtcggaaccgttaaccggtaccggttccggtaaacgggaccgggttaaccgtacgttccccgtaacccgttccgtaacccgtaaggtaaaccgaacccgtaaccgtaacccgaaacggacccggtaacccgttacgtacggtttactaccggtaacgtaactaaacggttaccgaaccgtacgtaccggttaccggaaccgtaccggaaccggtacggaaccgtaccggtacttagtagttacgttacggttcgacggcggtaaacggacgtacgtaacgcgaacccgtacggg

SEQ ID NO: 265400 - DNA, 879 bp, Homo sapiens
  misc_feature: GYAE6OF01CJ6DN.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttcctcgttgcttgttttaaagnggtgtccagtgtcgaggtgcagtcgtggtggacgtcggtggggggacgcggtcggccccgaggtcccggtacggggtaccgtacccgtagacgtaccgttccttccgtggtcgcgacgcgttcgttagtactttccaccgtttacgaagttacgtcagttcggctaagttcggaccgacggttccgggtaccccgcccggtaacggtcccgtaccggtaagggaccggggtaaggggtcgttaacggggtggggttacggggtaacgggacctttaagggttttaaatcgggtagggtttaagtaaggtaaggttaacgggtaaagttaacgtaactaaagtttacgacgttacggtacgaaccggttccggtacgggtaacggggtaaccggtccgttaaccgttacccgtacccggttaccaacccggtaacggtaaccgtaaacccgtaaaccgtaacccgaaaaccgtacccggtacgttaacccggtttaattaccgacgtaaaccggtaaacaaccgtacccggtaaccgttacgggacctaaccggggaccggaaccggtaacccggtaaacggtaaccccggttacgttcggtttaaccgttactttaaaccggtggggttccggtaggaaacccgggttaagaaacccggggaataaacccggtccccgggttaaaacggtacccgggg

SEQ ID NO: 265401 - DNA, 787 bp, Homo sapiens
  misc_feature: GYAE6OF01D1Z0W.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttcgttttaagaggtgtccagtgtcgaggtgcaggcgtggtggagtcgtgggggagcggtggtccagccgtgggacctccctgagtcctctccgtggtcgcgtagtccgttcgtaggtactttaccacccgtttgagttagtcagtcggcctagttcgaccgtacggtcgggtcccgacgtacggcctaccggaggggtaccggtaaaggggtcttaggggacgggtttggggacgtcgttaaaggtttacgtaggggttaggttagacggttaaagggtaagggtaaacggttactaacgtaaaggttccttaaggtccgtaacgtaacggttacccggttaccgggtaacgggtaacccggggttaccgtaccgtttaccggtaccccggttacgttaaccggaaaggtaacccgtaaacccgtaacccgtaaccccgtaaaacggacccttacggtactttacgtaaccttacgaacgtaactaaacggtccgaaccgtacgtcgttacggaacgccggtaaccggagtaccggaacggttatacggtttaagtacggtttacggtacgaacggaacgaaggttaacgaaccggttacgacccgtccgtaacggg

SEQ ID NO: 265402 - DNA, 751 bp, Homo sapiens
  misc_feature: GYAE6OF01AZL07.34.26.C04.1.454.CMB.1.raw
  modified_base (181)..(181): a, c, t, g, unknown or other
  misc_feature (181)..(181): n is a, c, g, or t
  modified_base (225)..(225): a, c, t, g, unknown or other
  misc_feature (225)..(225): n is a, c, g, or t
  modified_base (734)..(734): a, c, t, g, unknown or other
  misc_feature (734)..(734): n is a, c, g, or t
tcagtacacgtgatcacgaccggtgctcgatttagtctagcgactttgggtttggggctgggagaggagcccagcactagaggtcggcggttgtttccattcggtgatcagcactgaacacagaggactcaccatggagtttggctgagtcttgggtttcctcgttgcttacgttttaagngtgtaccagtgtcaggtgcagcgtgggtggagtcggtagggggngcggtcgcccgaggccgttcgggaccgtccgtaggacgtacctccttccggttgtgccgtaggtcgtcggtacgtactaccgcctttagacgttaacgtcagttggcctatcggtaccgtacggttccgggcccgacccgaacgtccgtaccggaggggtacggtaggggtactggggtagttcggggacggtacgtttaaaggttaacgttaggggtagttaccggaaggtaacgttaaacggggaattaacggtactaaacgttacgtagtcggaacgtacgtaacgggttccgtaacggggtacgtaccgttccgttaaccctcccgttaaccgacggtacggaacctaacgtaaccccgtaaccgaaataacccggacggttacgacttacgccggttaactaaacccggagttaccgaaccgtaccgttaacggacgacgacggtaccgaagtacccggtactaggttaacttgtaaacttcgggacagtacgacgggttaaanacgaaccgtcgtgaacg

SEQ ID NO: 265403 - DNA, 846 bp, Homo sapiens
  misc_feature: GYAE6OF01AN7BE.34.26.C04.1.454.CMB.1.raw
  modified_base (710)..(710): a, c, t, g, unknown or other
  misc_feature (710)..(710): n is a, c, g, or t
tcagtacacgtgatcacgaccggtgctcgatttagtctagcgacttttgggtttggggctgggagaggagcccagcactagaggtcggcggttgtttccattcggtgatcagcactagaacacaggagactcaccagtgggtagtttgggctgagtcgtttcgggtttttccctggttgtctttacgtttttaaaggaggttcgtacctaggttgtacggagggtcgactaggtcgtagggtggtaggtcggtggggggacgtccggtcgggaccccgtaggtcccggtaggggtaccttcccgtagacctccgttcctcgtggatcgacgtcgttacgacgtacttccgtaaccttgtagggtactcgtacgtggacctagtccggaccggttacgggttccgggtcccccgacgtaaccggggtccttaaccgggacgggtaccggggtaacggggtggttacggggacggggttgggtaccggtagtttaaggttaagttggtaaggtctagggtaagttacggggtaaagtaccgttaagttaacgttattacgcgttacggaagttccggtaggggacgtaacggtccgtacgttaccccgtacgtacgcgaaacgtaaccgtaacccgtaacgtacccgtaaagaccctaggttacttaccttcgtaacgtacggtaaaaccttcgtaaccgggtaaaccccgngttacggggaaccaccggggtaaccggaacccggaagttaccccggtagtttaaccgtaacggtttatttaacctcggggtaaccgtgaaaccggtacggtaaacggacccaacgggtccctaaacggtaaccggg

SEQ ID NO: 265404 - DNA, 835 bp, Homo sapiens
  misc_feature: GYAE6OF01BYF15.34.26.C04.1.454.CMB.1.raw
  modified_base (195)..(195): a, c, t, g, unknown or other
  misc_feature (195)..(195): n is a, c, g, or t
tcagtacacgtgatcacgaccggtgctcgatttagtctagcgacttttgggtttggggctggggagagggacgcccagcactagaggtcggcggttgtttccattcggtgatcagcactagaacacagaggactcacagtggtaggtttggctagagtcgttcgggttttcctcgttgtctttacgttttaaggnggtcgtaccgtaggttgtcgtaggtgaccgtaggtcgttgggtggtacggttcgggtaggggggacgtcggtccggacccgtacggcccggttacggggtacccgttacccgtaggaccgttccttccgttccggtggtacgacgtacggtcgttcgttaggttaaccttaccttaccgttacgagttacgtacaggttcgactagtcggaccgtaccggggttcggacccgtaccgacggtccgtacggacgggaacgggaacggggtcgttaggggtacgggtggggtacgtacgttaaggttagttaggtaggtagaggttaaggtaacggtaaagttcgtaactaacttacgtagtacgacgtaacggtaccggtacggtacgggtaacggtaccttacgtacctacccggttacaacgtaacgtaacgtaaccgaactaacccgaaacgtaccgccgtacttacgtacgtaacgaccgtaataccggacgtaaccgaccgttagggaaccgtacggacccggaaaccgggtaaccacccgggtagtaacccggtttagttaaccggtttaatccgggtagggtacgacgggaaacgttaccgaaccggtaaggtaccccgtcggttaaaccgggg

SEQ ID NO: 265405 - DNA, 900 bp, Homo sapiens
  misc_feature: GYAE6OF01D82M7.34.26.C04.1.454.CMB.1.raw
tcagtacacgtgatcacgaccggtgctcgatttagtctagcgactttgggttggggctgggagaggagcccagcactagaggtcggcggtgtttccattcggtgatcagcactgaacacagaggacctcaccagtggtaggtttgggctggagtcgttcgggtttttcctcggttgctttcgttttaaggagggttcgtccctaggtcgtacgtagggtgacgtaggtcggtagggtgggtacggttccggggttggggggggacggtccgggttccgggaccccggtaacggtccccgggttcgggggtacccgttccccgtgggtacgtaccttcccgtccgttggtacggccgtaggtccgttcggttgggttaaccttccgtacctttacgacggttagtccgtagtcggtctagtcggtacgtcggtacggcccgacgcggtcctacggacgggacggaaggggtctaggggtacgggttcgggtagtacttaggttaacgtagtacggtgtaacggaggttaaggtaaacggttataaccgtaaataccggtatccgtaacgtacggtttaaccccggtcggtaacgggtaacccgggtacgttaccgttaacccggtcccgttaccggtaacgaaacggttaaaccgaaccggtaacctaaccccgggaaactaacccggcggttacgttacgtttaacccacggttaactaacggtaaaccgtaccccggtaacgttacccggaaccgggtaaggaaccgggtaccccggggtaaacggaaccggtaccgggttaccggttaacgttcgtttaaacggtttccgtacgggtcgggtaacgttaacgggaagggttacccgaacgggaaacccgtccggtgtttaaacccggg

SEQ ID NO: 265406 - DNA, 585 bp, Homo sapiens
  misc_feature: GYAE6OF01EDQC6.34.26.C04.1.454.CMB.1.raw
  modified_base (179)..(179): a, c, t, g, unknown or other
  misc_feature (179)..(179): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (553)..(553): a, c, t, g, unknown or other
  misc_feature (553)..(553): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggcccagcctgggacctccctgacgctctcctgtncagcgtctggattccaccttnagtagtcatggcatgcacgtgggtcccnccgaggcctccgagggccaaagggggcctgggacggtggggtggactaggttatagtgggtatggaagtggaaagtacgtacaaagtactagtgacctagacctccggtaggaacgggccgtattccgacccgtcctaccaaggaacgaccaactacccaaagaacaccggacttagtactcgagacaaacgtcgaaccagcctagacgacgacccggaggacaccggcttaacgtgtacttacgngtcggacgagaaggacgaacgacgccgtaccg

SEQ ID NO: 265407 - DNA, 568 bp, Homo sapiens
  misc_feature: GYAE6OF01A3D5Z.34.26.C04.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
tcagtacacgtgatcacgaccggtgctcgatttagtctagcgactttgggtttggggctgggagaggagcccagcacgtagaggtcggcggttgtttccacttcggtgatcagcactgaacacagaggactcaccatggagtttgggctgagcgtggtttcgcgtagctcgttaagaggtncctagngtcaggtcnagcgtggtggagtggtggggaacgcgttcggcccaggtcccgtagggctccctgacgtacctctccgtaggcgactgcgtcgtaggcttcaccgtcgngtaactcagtcganatcgcagtccggcgccnggcctcgaggcggagggntggtaggnggtcgatagtaatcgtgganagtagtggaactgaatacgtanagttnagacgtctacgaacggacggacttactccncgttacaccganacgaacactaccgagaacacgtttgacttcaggacacaacgtnaaccggtnaccaggcggacaaccgggnttacggactaccttggagttatcgtaagccgagaacgtcgaaancgaanccttacggg

SEQ ID NO: 265408 - DNA, 746 bp, Homo sapiens
  misc_feature: GYAE6OF01ALBYL.34.26.C04.1.454.CMB.1.raw
  modified_base (178)..(178): a, c, t, g, unknown or other
  misc_feature (178)..(178): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttggctgagctgggtttcctcgttgctcttttaagaggtntccagtgtcaggtgcagctggtgagtcgtggggagcgtggacccagccgtggacgtcccgtagacgtactccgtccgtgtcgacaggtcgtcgtaggtacttccgaacctttcgagtacgtacagttcggacatcgaccgtacgtcggcctaccaacggtcctacgaggacgaagggtcgtagggtacggtgggtacgacgttaagttaacgtagttacgggtanaggtaagtaacgggtaaatacggttaacaaacgttacgtaaggtccgtacgaacgtaccggttaccggaagggtaaccggtacgtaccgtttaccgaaccggttacccgtaacggaacggtaaactaacccgtaaacggttaaccccgaaaaggtaaacccgccgggttactaacgggtaaccttaccgtaaggaaccttaaaccggaccgttaaacccgaggtacccgtaaggaccgggtaacgaccgggaacgtacccgtaagggttaaccttggtaacgttaacgttcgacgggtaagacccggtaaggaactacccggattaccggacggttaaaccgg

SEQ ID NO: 265409 - DNA, 778 bp, Homo sapiens
  misc_feature: GYAE6OF01C4A7S.34.26.C04.1.454.CMB.1.raw
  modified_base (447)..(447): a, c, t, g, unknown or other
  misc_feature (447)..(447): n is a, c, g, or t
  modified_base (745)..(745): a, c, t, g, unknown or other
  misc_feature (745)..(745): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtaggtttgggctggacgtcgttcgggttttcctcggttagctttacgttttaaaggaggttcgtacctagtgtaccgaggtcgcgtagcgtagggtggtacggtcgggtgggggcgtcggtcggcccgagtccgtagggaccgtcccgtagacgtacctcgtccgtgtacgtcgcggtacgtcgtaaggtcttacctaccgttagagtaacgtccgaagtcggactacgtcggtaaccgtcgggttacccggccgacccgttacggcccttaccggtaaagggccgggtaaacggggtcgttaacggggnggtccggggttacggtaacgtttaagtttagtacgtttaaggacggtaaaggtttaaccggacgggtaaaagttaccgtaactaaagtaaccgtggttaaacaccggtaacgtcccggtacggtaacgggtaacgtccgtaacgtccgtacccgtacgtaacgacgaacgaactaaccgaacgacgaacgtcactgaacctagtaaccgaagaccgtacgaccgtacgaacgtcggaacgaccggtacggaaccggtaccgacgtaacgttaaccgtagtttactacgagttacgganaacggaaccgagttacccacggtaacccgtcgg

SEQ ID NO: 265410 - DNA, 830 bp, Homo sapiens
  misc_feature: GYAE6OF01DHCCI.34.26.C04.1.454.CMB.1.raw
  modified_base (477)..(477): a, c, t, g, unknown or other
  misc_feature (477)..(477): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcacagtggagtttgggctgacgtcgttcgggtttttccctcggttgccttacgtttttaaagggaggttcgtacctaggttcgtcgagggttgcgagcgtgggtgggagtcggtggggggacggccggtcggccccgtaggcccggttacggggacccgtccctaggaaccgtaccgttccttcccgtaggtcgccgacggtccgttcgttacgggttaccttaccctaacccgtttagtaaaggttacgtacgaaggttcggcctaagttccggaaccgtaccggttccggggtcccccgacgtacgggtcccaccgggagggtaccggtaagggggcgttaggggngggttcggggtagtacgttaaggtttataaggttgggtaacgtagggtaacggtagggttaaaaccgttggttaacctaaagtttaccggtaagttcgggtaacgtaacgggtacccggttaccgggtaacgggtacgggtacccgtacgttacccggtaccccgtaccgttaaccgaacgaccgaaccgtaaccctaacccgtaaacggaaccgaccgttacgtacgttacttacgaacgtaacgtaacgtaccgaccgtaccgaccgtagacgacggaccggacggaccggtacgacgttagttagtacttcgagtcggaagtacggaacgacgaaactcgacccgtacgg

SEQ ID NO: 265411 - DNA, 809 bp, Homo sapiens
  misc_feature: GYAE6OF01D1TAL.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtggggggacgcgtggcccagccgtgggacctcccgtgacgtactcgtcctgtcgcaggcgttcgtggtacttccacctttcgagttagtcagtggacagttcgaccgtacgtcggggtcccaccgtacgggtccctaccggagggaccggtaaagggggtcctaggggtacggttgggggtggaccgttaaggtttatagttgggttaatggagttagggtaaacgttacgtaactaaacgttacgttagtacggacgtaacggtaccgttaccggtaagggtaaccgggtacccgttaacgtttaccccggtaccccgttaccgtacccgaaaggtaaccgtaaaccctaaaccgttaacccccgaaaaggtaaacccgtaaccggtacccgtttaggttaaccgttaccgtaacggtaaccgttaaaaaccgtacccgtaacccgaacggtacccgttagggaacggtaacccggtaaccgggaaccgggtaaccgtaaccggtaacgtttaacgtttaggtttaacctttaacggtacgggtacgaaccgggtaaggaacgtaacggtaaacccgaccggtacccgtaacccgg

SEQ ID NO: 265412 - DNA, 837 bp, Homo sapiens
  misc_feature: GYAE6OF01DTVSY.34.26.C04.1.454.CMB.1.raw
  modified_base (219)..(219): a, c, t, g, unknown or other
  misc_feature (219)..(219): n is a, c, g, or t
  modified_base (797)..(797): a, c, t, g, unknown or other
  misc_feature (797)..(797): n is a, c, g, or t
tcagtacacgtgatcacgaccggtgctcgatttagtctagcgactttgggtttggggctgggagaggagcccagcactagaggtcggcggtgtttccattcggtgatcagcactgaacacgagaggactcaccatgggtaggtttgggctgacggtcgtttgggttttccttcgttgtcctttacgttttaacggaggtctacaggttgtcgaggtcgngtacggtcggtgggtgggaggttcggggtaggggggacggtccggtccgggaccccgacggtacccggttcggggtaccccgttccccgaggtaaccgtcctttcccgttaccggtcgtcgaccgtcggtccggttacgtacggtacttaccgttacccttagtaacgtacgtacacggtcggtctacgtcgtcccggtacggtccgggtccccggaccgacgggtccctaccggggaacggggaccggacggggtcggttacggggttcggggtcgggggttagtaacgttaaggtttaacggtagttacgggttagtagggtaaggtaaaggttaacgttacgtaaactagttaacgtagaccgtataacccgggttacgtaccgggtaacgggtaacggttcccgttaacgtaccccggttaccgtaccgtaacgaaacggtaaacgtaacccaaccgtaaccgaaacccgtacgaccttcgtacgtacacgtaacgaataaccgacgaccgtacacgtacgacgcgaacccgacggaacgtacgtacgttacgttagtaccgttggcgggtaanacgggtaacgaacggaccgtaaccgtaacgcccggtacgg

SEQ ID NO: 265413 - DNA, 860 bp, Homo sapiens
  misc_feature: GYAE6OF01BNN4C.34.26.C04.1.454.CMB.1.raw
  modified_base (168)..(168): a, c, t, g, unknown or other
  misc_feature (168)..(168): n is a, c, g, or t
  modified_base (189)..(189): a, c, t, g, unknown or other
  misc_feature (189)..(189): n is a, c, g, or t
  modified_base (275)..(275): a, c, t, g, unknown or other
  misc_feature (275)..(275): n is a, c, g, or t
tcagtacacgtgatcacgaccggtgctcgatttagtctagcgactttgggtttggggctgggagaggagcccagcactagaggtcggcggttgtttccattcggtgatcagcactgaacacagaggactcaccagtggtagtttggctggagtcgttcgggttttccncgtttgacttacgttttaagnggtgtccaggttgtcgaggtgcagtcgttgggtaggagtcggtggggggagtccgtacggcccaggtccggtgggacccgttaccnggacgtccttcgtccgtggtacgaccgtggtccgttcgtacgggtactttacccgtacccgtttacgtaaggtttactaccgtagttgggacctaacgttcggaacccggttaccgggttaccggggtccccgacccggacgggtaccgtacccgggtagggaacccgggtaagggggtacccgtgggggtaacgggtttcgggggtacggtaaccgttaggggttttaagttacgggtttaacggttaaggttacgggttaaaggttaaacgggttaaacggtttaacgtaaacgtaaaacggtttacgttaacggacggtaccggtaacgtacccgggttacggtaacgggtaacgggttaccgtacgtttacccgacccgttaccgtaacggtaaccgtaacgaaccgtaacccgtaaccgaaacgtaccgtacgtacgttaccgtacgtacgtaacgtaacgtaacgccgtaacgcgtacgacggtacacgggacggtaccggacgaacggttcgaacggtttaccgaaggttcggacgtaacgggacgtacggaacgaccgacgtaccggccttaacggg

SEQ ID NO: 265414 - DNA, 889 bp, Homo sapiens
  misc_feature: GYAE6OF01C1H0N.34.26.C04.1.454.CMB.1.raw
  modified_base (159)..(159): a, c, t, g, unknown or other
  misc_feature (159)..(159): n is a, c, g, or t
  modified_base (241)..(241): a, c, t, g, unknown or other
  misc_feature (241)..(241): n is a, c, g, or t
  modified_base (469)..(469): a, c, t, g, unknown or other
  misc_feature (469)..(469): n is a, c, g, or t
tcagtacacgtgatcacgaccggtgctcgatttagtctagcgactttgggtttggggctgggagaggagcccagcactagaggtcggcggtgtttccattcggtgatcagcacagaacacagaggactcacatggagttgggctgagcgttggtttccngtgcttatttaagaggtgtcctagtgtcgaggtgcagcgtggaggacgttcggggggggtacgcggcggccctaggtcccgngggtacccgttccaggacgtcctcgtaccgtggacgccgtaggcgtcgtcggtacttacctaccgttgtaggttactcgaaggtccgacaagtcgggaacccctacgggttccggggaccctaccggacgaaccggtaccggacggggacggaaagggggtttccgtaaggggtagggttcgggggtacgggacttaaggtttaacgttaaaggaggggttaaaccgngggtaaagttaagggaaaccggttataaccgtaaataccggtaaaggtcgaaacgtaaggttaacccgggtaccggtaaggggtaaaccgttcccggtaaacctttaccccgtaaccgggacccttaaacgggggaaaccttaacgggaaaaccccttaaacggtaaacccccggaaaaaacgtacccgaaccgggttttacaacggttttaaccttacgaaacccggaaagtaaaccggggttaaccctaaacccggacccgaaggggttaaccggacggtaaccccggaaccgggggaaccttaaaacgggggtcgtaaaccgttaacggtttaagggtaaaccggttcccggttaaggtacgggaaaccggagggtaaaaacggcgggtaaaccccttaaacccggcccggtaaagg

SEQ ID NO: 265415 - DNA, 831 bp, Homo sapiens
  misc_feature: GYAE6OF01DC8HW.34.26.C04.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (490)..(490): a, c, t, g, unknown or other
  misc_feature (490)..(490): n is a, c, g, or t
  modified_base (625)..(625): a, c, t, g, unknown or other
  misc_feature (625)..(625): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttggctgagctgggttttccngttgcttctttaagngtgtccaggtgtcaggtgnagcgtgggnggagtcgngggggagcgtcggcccagtcccgtggggaccttcccctgacgtacttcctcgtgtagccgaggccgttcgtacggtaacttcctacccgtttagaagttacgtccgaagttcgggacacgttggaacccgcggttaccgggggccccaccggtacggtcctacccggaaggggtcccgaaaaggggggtccttagggggtaacgggtcgggggtaggtccgttaacggtttagtaggtttcggttaagtaggaagtttacgggtaaaagttacggttaanaaggtttaaccgagttccgacgtacgtacccgggttacggtaacgggaaaccggtacccggttatacccgtacccgttccgtaacccggtaaagtaccggaaaccctaaacgtaacccccgaaaacggtaaaccnccggtttacgtaacgtttaacgaccggtttaacgaaccggaaaaccgtttaccgaacccgtaacgggttacccgaaaggggacggttaaacccggacccgggggtaaacaaccggttacggttactaacccggttagtttaaccgttcggttacgggtacgtacgggaaacgttacggaaccgaaacgtccgtacccgtaaacggg

SEQ ID NO: 265416 - DNA, 761 bp, Homo sapiens
  misc_feature: GYAE6OF01CUGCW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcacagtggagtttgggctgagtcgttgggttttcctgttgtcttacttttaagaggtgtccagtgtcaggtgcagtcgtgggtggagtcggtgggggagccggtcggccccgaggtcccggtcggggtacccgtcccgtagacgtaccttccgtccgtggtcgcgacgtcgtcgtaggtacttcctaccgttgtaagttacgtcgagtcggactagtcggtaccgtacggttccggggtcccgaccggacggcccgtaccgggaacgggaccgggtaaggggtccggtaggggtacgggtggggtacgtacgttaaggttagtaggtaggtagtaggtaagtaggtaagtacgtaactaagttacgtagtacgaacgtacggtaccgttacgggacgggtaaccggtacctaacgttaccgaccccggttacaaccggaacgtaacgaacccgtaaccgtaaacccgaaacgtaaccgtccgtaacgttagtaacctacgtaccgaacgtaacggtacccaccgtagtaccgtaggaccggacggacccggaacggtaaccgtaacggttacttaaggttacgtttacggtgtacggtacggagtaacgacgaccgacgtacgccgttaacgg

SEQ ID NO: 265417 - DNA, 768 bp, Homo sapiens
  misc_feature: GYAE6OF01ERPW6.34.26.C04.1.454.CMB.1.raw
  modified_base (596)..(596): a, c, t, g, unknown or other
  misc_feature (596)..(596): n is a, c, g, or t
  modified_base (733)..(733): a, c, t, g, unknown or other
  misc_feature (733)..(733): n is a, c, g, or t
  modified_base (749)..(749): a, c, t, g, unknown or other
  misc_feature (749)..(749): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggttttcctcgttgcttacttttaagaggtgtccagtgtcgaggtgcagtcgtggtggagtcggtgggggagcgtcggcccagccgtgggaccgtccctggacgtcctctccgtggtacgcacggtcgtcgtggtactttccaccgtttcaaggttagtaccagtcggtacctaagttccgaccgtaaccggttccggggtacccgtacccgaagggtcctacccggaggggtaccggaagggggtcctagggaccgggttggggacggtacttaaggtttaagaggttagggtaacgttggaagtagggtaacgttagtaactaaacgtactaagcggtactaacggttccgtaccggtaacgggtaacggcccttacgttaaccgacccgttaccaacgaggtaacaacccgttaacaccccgtaaagaaccccggtancgtttacgtactacctaacggaacgtaaactccggtaacccgacggacgttaagggaccgacccgggttaacggaaaccgggtaccgtaccgttagttaaccgttaagttaacccggttgaacgggtcgaaacgggngtaaaggaaaccccgngtaaccctccggtaaacgg

SEQ ID NO: 265418 - DNA, 648 bp, Homo sapiens
  misc_feature: GYAE6OF01ESTTY.34.26.C04.1.454.CMB.1.raw
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccaggtgtcaggtgcagctggtggagtcgtgggggagcgtggcccagcctgggactcctgacgctctctggtgcacgtcgtctggtacttccgaccttcagttagtcatggcatgctcgtcgggtccncgaggtctaccgaggcgaagggcttagggagttggggtcggcagttagtagtggtatcggtattagggaattacggtactaaagtaccagtcggactacggacgtaccgtaggaaacggggccgtacttccgtacccgtctaaccggtaagacctaacgaaaccgtaccaaacgtaacgtacgtaccgttgtaacttcgacgtaacaaacggtcaaccggtacgtaccgttacggacggacgggaccggacgggaaccgtacgggacttacggtatttacgttaaccggtgttacggaccggtacggtaacggaacgacgtaccgacctaaccggg

SEQ ID NO: 265419 - DNA, 696 bp, Homo sapiens
  misc_feature: GYAE6OF01AT92I.34.26.C04.1.454.CMB.1.raw
  modified_base (119)..(119): a, c, t, g, unknown or other
  misc_feature (119)..(119): n is a, c, g, or t
  modified_base (221)..(221): a, c, t, g, unknown or other
  misc_feature (221)..(221): n is a, c, g, or t
  modified_base (441)..(441): a, c, t, g, unknown or other
  misc_feature (441)..(441): n is a, c, g, or t
  modified_base (650)..(650): a, c, t, g, unknown or other
  misc_feature (650)..(650): n is a, c, g, or t
tcagtacacgtgatcacgaccggtgctcgatttagtctagcgactttgggttggggctgggagaggagcccagcactagaggtcggcggtgtttccattcggtgatcagcactgaacanagagactcaccatggagtttggctgagtcgtgggttttcctcgttgcttacgttttaagagtgtccagtgtcaggtgcagcgtggtgagtcgtggggagcgnggtcccagtcccgtgggtccgtccctggacgtaccctcgttccctaggtccgacacggtccgttcgtaggtaccttaccctacccgtttactaaggttacgtccaaggtcggactaaagtccggtaccgacggttcccgggcccgtaccgacgggtccctacgacgggtccgaaggggtcctaggggtaggtggggtacacgtagttagtagtggttaancggagtaaggtagttagtaacgtataacgtgtagaccgtacgacgttccggaaggtaccggacctaccggttactacccggtacctaccgaagaacgaaccgtaaccgtaaccaaccgtaacgaccgtcttaacgtactacgtagtaactaccgttacccgagtaccgtagacgaccggacgtaacgaccggattacgtagttacgttntacggtcgacgtaggaccgagtaaccacgtacgccgtacggtaccg

SEQ ID NO: 265420 - DNA, 894 bp, Homo sapiens
  misc_feature: GYAE6OF01B2I5N.34.26.C04.1.454.CMB.1.raw
  modified_base (195)..(195): a, c, t, g, unknown or other
  misc_feature (195)..(195): n is a, c, g, or t
tcagtacacgtgatcacgaccggtgctcgatttagtctagcgactttgggtttgggctgggagaggagcccagcactagaggtcggcggtgtttccattcggtgactcgagcactgaacacagaggactcacctagtcggagtttgggctggagtcgttgggtttttcctcgtttgacctttacgttttaaaggngggttcgttaccctaggttcgtcgaagggttcgcgtagcgttgggtaggtaggtcggtggggggacgtcgggtcggccccgaggtccggttcgggaccgttcccgtaggaaccgtaccttccgtccgttggtcgaccgtacggtccggttcgttgggtactttacccgaccttacgtaggttacgtcgaagttcggactagtcgcgtacggtccgggtcccacgacggtcctaccggaggtacggaaggggtctagggtaggtcgggtggaccgttaaggtttaatacggttggttaagtcggtaaggtacgggtaaacggttacgtaacgtaacgttaccgtaggtccgacggtaacggttaccgtccgggtaaggaaccggtaccgttacgttacccgacccgttaccgtaaccggtaacgaaacgtacccgtaaaccggttaaccccggaaacggtaacccgttaacggtaccgtttacgttaccgttaacggtaccgtaaaccgttaaaccgtaccggtaaccttaccgggacccgttaacggaaccgggtaaccggtaacccgggaaccggttaaaccgggtaccgttaaccggtttacggttaacggttttaacccggttacgggttacgggtaacgtaacccgggtaaggaccggtaaacgggtcccggaacccgtccggttaaacccgggg

SEQ ID NO: 265421 - DNA, 694 bp, Homo sapiens
  misc_feature: GYAE6OF01D7H39.34.26.C04.1.454.CMB.1.raw
  modified_base (262)..(262): a, c, t, g, unknown or other
  misc_feature (262)..(262): n is a, c, g, or t
  modified_base (662)..(662): a, c, t, g, unknown or other
  misc_feature (662)..(662): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcttgggttttcctcgttgcttcttttaagaggtgtccagtgtcaggtgcagcgtggtggagtcgtgggggagcgtcggcccagcccgtgggacctccctgagacctctctgncgagtcgtctggatttccaccttgagttagcatggactatagctacgttcgggtcccgaccgacggtctaccgacgggacgtaagggggtctaggggaggttgggggtacggtcgtaaggtttataggttagggtaagtggtaaggttgggtaaaaacgttacggtaactaaaacgttaccgtagtaccgaacgtaacggtacccgtcgggtacgggaaacgggtcccgtaacgttacccgtacccgtaccgtacccgaagtaacgaaccaaaccgttaacccgaaaacgtaacctccggtacttagttactacgtcgtaaacgaaactacggaaccgacgtaccgaaggtacggaaccggtaacggacggaaaccgtacggtactagttcgtaattcgnggtaccggagacggagaagaccgcgactaccg

SEQ ID NO: 265422 - DNA, 856 bp, Homo sapiens
  misc_feature: GYAE6OF01BCU6I.34.26.C04.1.454.CMB.1.raw
  modified_base (515)..(515): a, c, t, g, unknown or other
  misc_feature (515)..(515): n is a, c, g, or t
  modified_base (674)..(674): a, c, t, g, unknown or other
  misc_feature (674)..(674): n is a, c, g, or t
tcagtacacgtgatcacgaccggtgctcgatttagtctagcgactttgggtttgggctgggagaggagcccagcactagaggtcggcggtgtttccattcggtgatcagcactgaacacagagactcaccagtggagtttggctgagtcgttgggttttcctcgttgcttacgttttaaggaggttgtccgaggtgtcgagggtcgcgagcgtgggtggtacggtcggtgggggagccggtccggcccgacggtcccggttgggacccgttcccgtggaaccgtaccttccgtccgtaggtcgacgtacggtccggttcgtaggttacctttccgaacccttttacgaaggttcgttacgtacggtcgggacctagtccggaccggttaccgggtcggggtcccccgaccgacggggttcccaccgggaacgggtacccgggtaaagggggtcgtaggggtacggggttcgggagtaccgttaaggtttaagtaaggttcgggtttagtaacggnggtttaaaggggtaactttaacggtacttaaaaacgttcgttacggtgaacccttaacgggtacccgttacgggtacggaaccgggtccgtaacgttccgtaaccccggttcaaccgtaacgaccgtaacctaaccgtaaccgaaccgtaacctaccgngtttaacgtactacgtacgtaacgtaacgacccgtaacgaccgtaccggtaacggaccggtaaccggaacggtaccggaaaccgttaccggttaacgttcggtttaacggtaacgtttcggacggttaacggacgggtaaaccgtacgggtaacccaacggttaacccgcccggtaaaccgg

SEQ ID NO: 265423 - DNA, 765 bp, Homo sapiens
  misc_feature: GYAE6OF01B5OS1.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggtttttccctcgtttgcttacgtttttaaggaggttcgtccagtgtcgaggtgcagcgtggtggagtcgtgggggacgcgtcggcccaggcccgtgggaccgttccctaggacgtaccttcctccgtggtcgctaggcgttcgtggactttccgaaccttgtaagtacgttcaagtcggacagtgaccgtaccggttcggggtaccccgaccgacgggtcccctaccggacgggaccggtaaaggggggtccttagggggtaacggttcggggggtacggtaccgttaaacgggtttagttaaggttgggttaagtacggtaaaggtttaacgggggtaaagtttacggttaactaaaagtttacctaggttacggaccgtaacggtacccgtaccgggttaacgggaaccgggtaccggtacctttaccgacccgttaccgtaccgaagtaaccgacgtaaaccgtaccgtaaacgaccgtacgtactagttactcgagtaacaacgtaccgaacgtacgacctaggacgacgaccgtacggaccacggtacttacgtagttacgttagtcggtacgacggtacgaggaaccgacgacgacgtaacgg

SEQ ID NO: 265424 - DNA, 701 bp, Homo sapiens
  misc_feature: GYAE6OF01CD0FT.34.26.C04.1.454.CMB.1.raw
  modified_base (684)..(684): a, c, t, g, unknown or other
  misc_feature (684)..(684): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgacgtcttgggttttcctcgttgcttacttttaaggagtgtcagtgtcaggtgcgagcgtggtggagtcggtgggggacgcggtcggcccgaggccgtgggaccgtcccgtgacgtctcgtcctgcgcagcgttcgtgtacttcctaccttcgagtagtcagtcggctagtcgactcggttcgggtcccaccggtacggtccctaccggagggaccggtaaggggtccgttagggggaaggttcggggtagtacggttagtttaagtagttaggtagtagtaaggtaggtaaagttaacgtaagtaacttagtatcgacgtaacgtaccgtacggtacgggaaccggtaccttaccgtaccgtaccgtaccgtaaccgaagggtaacccaaccgtaaaccgaaacccgaaacgtacccgtacgtacgttagtacgtcgaacgtaactaaacgccgtaaccgagacgtcggaacgtcgaccggacgtaccgtagtaccttaagttacgtaagttcgcgtaaggacgtaacgtacgaanacccgtagccgtaacgg

SEQ ID NO: 265425 - DNA, 842 bp, Homo sapiens
  misc_feature: GYAE6OF01BKB10.34.26.C04.1.454.CMB.1.raw
  modified_base (90)..(90): a, c, t, g, unknown or other
  misc_feature (90)..(90): n is a, c, g, or t
  modified_base (161)..(161): a, c, t, g, unknown or other
  misc_feature (161)..(161): n is a, c, g, or t
  modified_base (176)..(176): a, c, t, g, unknown or other
  misc_feature (176)..(176): n is a, c, g, or t
  modified_base (774)..(774): a, c, t, g, unknown or other
  misc_feature (774)..(774): n is a, c, g, or t
tcagtacacgtgatcacgaccggtgctcgatttagtctagcgactttgggtttggggctgggagaggagcccagcactagaggtcgcgtnttccattcggtgatcagcactgaacaccagagactcaccatggagtttggctgagtctggtttcctcgttncttctttaagaggtntccagtgtcaggtgcagctggtgagtccgtaggggacgcgtcgcccagcccgtgggaccgtcccgtaggacgtaccttctccgtagtcgtcgaacggtccgttacgtcggtaactttaccccgtaacccgttacgtaaacggttaccgtaccgtaagttacggtaaccctaagttccggtaaccgtaacccgggtttcccgggggttaccccccgaaccccggttaaccggggtccccgtttacccgggaaccgggtaccgggtaaacggggggttcccttaagggggtaaccggttggggttaccgggtaacccgtaggttttaaacgttacggttcggtaacggttaccggaagtttacggggtaaaccgttaacggtaacctaaaaccgttacgttacgtacggaaccctagggttaaccccgtccggtaaacgggtaccggtacccgtactttcccggaaacccgttccgaacctagggaactaacccgaacctaccccgaaagacccgtaccgtagttactacctcggtaacactaaccgtgtaaaccccgtgtaccgtaacgagacccggtacgggaaccgcggtaacccgngttaccgttacgtaacgttccgaaggtaccgtcggaacggtacgtaaccaaccgtccgtacctaacgg

SEQ ID NO: 265426 - DNA, 846 bp, Homo sapiens
  misc_feature: GYAE6OF01B41F2.34.26.C04.1.454.CMB.1.raw
  modified_base (185)..(185): a, c, t, g, unknown or other
  misc_feature (185)..(185): n is a, c, g, or t
  modified_base (214)..(214): a, c, t, g, unknown or other
  misc_feature (214)..(214): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccagtggtaggtttgggctgacgtcgttgggttttcctcgttgtcttactttaagnggttgtccgagttgtcgtaggtgcgtagngtagggtggacggtcggtaggggggcgcggttcggccccaggtccggtacgggtacctcccgtagacgtaccttccttccgtggtcgtcgacggtcgttcgttaggtaccttacccgttaccttccgtagttacgtacgtacgttcggactagtcgtacggtaccggttccgggccgaccggtaggcccgtaccggacgggtaccgggaacggggtcggttgggtacgggttacggggtacggtacttaaggggtttaataacgggtttaggttacggtaaggtaaacggtttcgggaaaacggtttcgtaaacgttaaacttacggtaacgtcggtaacgtaccggttaacccggttacgggtacgggtaacccgggttacccgttacgttaccccggtacgttaacccgtaccggaaggaacccttaaaccgaaacccgttaaacccgaaacctaaccgaccgtttacgtaacggttacctacggtaacggtaacctaacgtaccgaaccgtaccggaacgtcgaacggtccggaaccggtaccggtaccgaaacggtacgttactttacgggtaattccggtaaggcgttaacgggacgtaaggaaccgccgtaaaccgcgtaaacggg

SEQ ID NO: 265427 - DNA, 847 bp, Homo sapiens
  misc_feature: GYAE6OF01BS7R8.34.26.C04.1.454.CMB.1.raw
  modified_base (286)..(286): a, c, t, g, unknown or other
  misc_feature (286)..(286): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgagtcttgggttttcctcgttgcttcttttaagaggtgtccagtgtcaggtgcagcgtggtggagtcggtgggggagcgtcggcccagcccgtgggacctcccgtaggacgtacctccgtcctggtgcgtacgcgtcgnggtactttccgaccttcagtcgtctagttggacatcgacgacgtcgggtcccgccgacgggtctacccggaggacgggaacgggggtcgtggggtagggttggggtacggaccgttaggttaacgttagtagggtttacgtaggtaacggttagggtaaacggttacgtaaaccgtaaatttaacgttacgtacgtaaccggaaccggttaacccggttacccgggttagggtaaaccggggtacccgtttaaacccgttacccgttacccccggtttacccgtaaccggaaacggtaaaccggtaaaccgtaaacccgttaaaccccgaaacggtaaaccccggtaaccgtaccggtttaagttaccgtttacgtaaccgtaacgtaaaccgtaccggaacccgtaacgtaccccgtaggtaaccgggtaacccggtaccgggaaaccggacccggtaaaccggtaccgttacgttaacggtttaaccgttagtacccgggtaaggtaccgggtaaacggtacggaaaccggtaactaacccggtcgttaaaccccgggg

SEQ ID NO: 265428 - DNA, 658 bp, Homo sapiens
  misc_feature: GYAE6OF01COPSA.34.26.C04.1.454.CMB.1.raw
  modified_base (160)..(160): a, c, t, g, unknown or other
  misc_feature (160)..(160): n is a, c, g, or t
  modified_base (168)..(168): a, c, t, g, unknown or other
  misc_feature (168)..(168): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (183)..(184): a, c, t, g, unknown or other
  misc_feature (183)..(184): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (252)..(252): a, c, t, g, unknown or other
  misc_feature (252)..(252): n is a, c, g, or t
  modified_base (316)..(316): a, c, t, g, unknown or other
  misc_feature (316)..(316): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (502)..(502): a, c, t, g, unknown or other
  misc_feature (502)..(502): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggagtttgggctgagtcgtggtttcncgtagctnttaagngtntcngtnngtncngngtggngngtcgagggggcgcgtcgcccaggccgtagggccttccgaggactccttcgtcgnggtgcgagtcgtacgtgtacttcaaccttgagtactcagtgcctagcgcgtacggtcggtcccncgaggtccctacgagggaccgtagggtcgtagggacggtgggtactacgtaagttagtacggtaggtagacggtaggtacggtaatccgttaataaacgtntacganccgtaagtccgtacggtaaggaccgtaccgttactcccgtaacgtccaacgtaagccgtaacaaccgtacgaacgtacncgtaccgtatcgttacgaaacgtactaacgaccggtacacgtccgaagggacgtaccggcgtaacggaccgtcgtaaaccgttaagttagttaacggtcggttaacggacgaaacggtcgtaaaaggcccaaaccgggcctacccgttaacccggg

SEQ ID NO: 265429 - DNA, 656 bp, Homo sapiens
  misc_feature: GYAE6OF01ESRXG.34.26.C04.1.454.CMB.1.raw
  modified_base (642)..(642): a, c, t, g, unknown or other
  misc_feature (642)..(642): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgctcttttaagaggtgtccagtgtcaggtgcagctggtggagtcgtgggggagcgtcggcccagcccgtgggaccgttcccgtggacgaccttctccgtggtcgcaggccgttcgtggtacttccaccctttgaaggttagtctagtggcagttcgacgtaccggttccggggtacccacccgagggtccctacccggagggaccggaagggggtccgtggggaagttcgggggtgacgtaggtttatagtgggttatggagtggtaaagtacgtataaagtactagtcgacaggtacgtcggtgaaacggcctatccaccgtacaccgagaaccaacgtaactacccgaagaccacgtacgtagtactcgagaactaacgtcgaaccgagtaccgaggacgtaccgccggaacggaccgtaacggtcttaaacgttgttaacttaccgtagtacgaacgaggaacgaaccgacnccgaaccgtacccg

SEQ ID NO: 265430 - DNA, 737 bp, Homo sapiens
  misc_feature: GYAE6OF01A04P2.34.26.C04.1.454.CMB.1.raw
tcagtacacgtgatcacgaccggtgctcgatttagtctagcgactttgggtttggggctgggagaggagcccagcactagagttcggcggtgtttccattcggtgatcagcactgaacacagaggactcaccatggagtttgggctgagcgttgggtttttcctcgtttgcttcttttaagaggtgtccagtgtcaggtgcagcgtggtggagtcgtgggggagcggtggcccagccgtgggaccgtccctgacgacctctccgtgtcgcgagtcgtgtggacttcaccttcagtatcgatcggactagtcgccgtacgttcgggtccgaccgaggtcctcccgaagggtcggaaacgggggcgttaggggtaggttcgggtaggtactaggtttaatacggttggttaacgtaggtaaggtacggaaagttacgtaataacgtacgtaatggacacggtaccgtcggtaaggaacgggtaccgtacgttaccgacccgttcgtaccgaacgtaacgaacctaacgtaaccccgaaagaacccgtacgtaccgttacgtaacgtacgtaacgtaacgtaaaccgtaccgtaacccgtacgtacccgttaagggaacgtaaccgggaacccggtaacggaaacccggtacggttaccgttaacgtttacggttaacgtttaccgtggtaacccggtaacggaaggtaacgaacggaccgtacggcccgttaaaccggg

SEQ ID NO: 265431 - DNA, 974 bp, Homo sapiens
  misc_feature: GYAE6OF01C4PC8.34.26.C04.1.454.CMB.1.raw
  modified_base (135)..(135): a, c, t, g, unknown or other
  misc_feature (135)..(135): n is a, c, g, or t
  modified_base (950)..(950): a, c, t, g, unknown or other
  misc_feature (950)..(950): n is a, c, g, or t
tcagtacacgtgatcacgaccggtgctcgatttagtctagcgactttgggtttggggctgggagaggagcccagcactagaggtcggcggtgtttccatttcggtgatcagcactgaacacaggaggactcaccngtggtagtttgggctaggacgtcgtttcgggttttcctcggttgtaccgtttacgtttttaaaggacgggttcgtacccgtaaggttcgttacgtagggttggaccgtaggttccggtggggttaggggacgggttcgggtaggggggggaccgtccgggtccggacccgtacgggtccccgggttacggggtaaccccgttcccgttagggaaaccttcccgtttccgttccgtaacggtcggtaccggtaggtacccgttcgggttaacggtaactttacccggtaacccttttaacgaaacggtttcgtaaccgtaacggttcgggaacccttagtaccgggtaccggtttaaccggggtttccggggtacccgacccggttaaccgggtacccgttacccggggaaaggggtacggggtaaaccgggggtcggttaagggggtacggggttccggggtacggttaagttaacgttttaaggttaacggttaggggttaaagcggtaaggtaaggtaaacgttacgtaactaagtaccgagtacgacgtaaccggtcgtacggtaacgggtaccggtacggttaccgtaccgttaccggttaccgtaacgaaacggtactaacccgtaaccgtaaacccgtaaacgtacgtaccgtacgttacgttaacggtactaacgaaccgttaacggacccttaaaccgggccgttaaacccggtccggggaacggaaccgggtacggaacggtacccggaacggttacgttaaccgtagttaacggtttaccgacggttagacggtacggtaaacgntaaaccggccgtaacgtaaccggg

SEQ ID NO: 265432 - DNA, 822 bp, Homo sapiens
  misc_feature: GYAE6OF01CYZWW.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagttgggctgagtcttgggttttcctcgttgtcttcttttaaaggnggtgtcctagtgtcaggtgcagtcgtggtcggaggtcggtggggggaggcggtcggccccgaggtcccggtaggggtaccctcccgtggacgtccttccgtccgtggtcgcgtagccggttaccgtggtacttccctaacccgtttcgaagttacgtcgacgttcggacgtatcggacccgttaccgggtccggggtaccccgaccggtacggtacccccggttaccggaaggggaaccgggtaaacgggggggtcgttaggggtaacgggggttggggggttaccggacgtttaagtttagtacggtttagggtttacgtaggttaacgggtaaggttaacggtaacggttaacaagttttaccggtaaagttcggaccggtaacgtaccgggtttaaccgggaaggggtacccgggttaccgttaactcccggtaacccgtccgtaaccgaaggtaccgacttaaaccgacccgaaacgaaccgtcggtactacttacgtactacgaactaacggtccaaccgttacgggacccgtaaggtccgaaccgggacggtaaccgtaccggtacggtacttagtacccggttagttaaccggcggtacgaggtaacgacggtaacacccggagtacccgtagg

SEQ ID NO: 265433 - DNA, 752 bp, Homo sapiens
  misc_feature: GYAE6OF01A3SQA.34.26.C04.1.454.CMB.1.raw
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (219)..(219): a, c, t, g, unknown or other
  misc_feature (219)..(219): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccncgttgctcttttaagnggtntccagtgtcaggtgcagctggtggagtcgtgggggancgtggcccagccgtgggactccctgaacgctctccgtgtcgactgcgtctaggtacttcgaccttgagtagtcagtggactagtcgctacgttcgggtcccgaccgtaggtcctaccgagggtacccgaaacggggggtcttaacggggaaggttcgggggtacgtaccgtaaaggtttacgttaagttagggtttagacggtaagttaggggtaaacgtttaaggttaaccctaaaaagttttaccgtaaagttcggaacccgtaaacggtacccggtttccggttaaggggtaaaccggggttaaccgtacgttttaacccggaaccccgttacgacccgttaaaggaaccgtaacctaaaccgtacccgaaaacgacggttaaccgtacgtttactaacgtccgtaagaaccaaacgttcgaaacccgcgaccgtaacgacggacgtaccgagggacctaacggccgtttagacgttaggttacctgggaacacggtaaccgaggtaaccaacggtacccgtcgtaaccg

SEQ ID NO: 265434 - DNA, 902 bp, Homo sapiens
  misc_feature: GYAE6OF01CVW15.34.26.C04.1.454.CMB.1.raw
tcagtacacgtgatcacgaccggtgctcgatttagtctagcgactttgggtttggggctgggagaggagccccagcactagaggtcggcggtgtttccattcggtgatcagcactgaacacagaggactcacagtggtaggtttgggctggagtctttcgggtttttccctcgttgtctttacgttttaaaggaggttcgtcctaaggtgtcgagggtgccgagtcgtgggtgggaggttcggtggggggacgcggtcggacccgaggcccgtaggggaccctcccgtgacgtccttccgtccgtgtggcctaggccgttcgtacgggttacttaccctacccgtttacgaacggttaacgttaccaaggttggaccctaggtcggttcccgtaaccgggtttcggggacccccggtacccggtaccgggtacccccttaacccggggaacggggtaaccgggtaaacgggggttccggtttaagggggacggggttacggggggtcggtaacggttaaggttttaacgttaaggttttggggttaacggttaggtaagtttaaaggggtaaacggtttaaagttacctaaaaacgtttcgttaaacggtacgtaacccggtaacggtacccggttacggtaacgggtaacccggggtacgtaccttaccgaaccgttccgtaaacgaacgtaaccgaacctaaacctaacccgaaagaaccgtaccgttacgtacgttaaccgtcgtaacggtaacctaaacgtaaccgtaaccgttacgacccggtaacggtacgacgggtaacccggaacggaaccggtacggtaacgttacgtagttttacgtaaacgtcggtaggtacggaacgtacgggaacgaacgtcccggtaacgtaaaccgg

SEQ ID NO: 265435 - DNA, 751 bp, Homo sapiens
  misc_feature: GYAE6OF01AI1LM.34.26.C04.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccncgttgcttcttttaagnggtgtccagtgtcaggtgcagctggtggagtcgtgggggagcggtcggcccagccgtgggacctccctgacgacctctccgtgtcgcaggtcgttcgtggtactttcccaccgtttcgaagttacgtcaagttcggactagtcgaccgtacggttccgggtcccgacccggtacgggtccctacccggaagggaccggtaaacgggggtccgttagggggtacggttgggggtcggtacttaggtttaacgtagttacggttagtaggtaggtaggtaaacgttacgtactaaactagttagtacgccgtaacggtaccgtccgggtaggaaccggtccgtaccgttaccgacccggttacctaccggaagggaacctaacccttaaaccggaaccccgaaacgtaacccgtacgtccgttaacgtccttaaccggtacgaaacctaacgtcccggaaacccgtggtacccgtaacggaaggacccggaccggaacggaaccgtacggttacttagttaaggttaactccgtaggcgaacggtaaccgagtaacgaccgacgtcccgtacgg

SEQ ID NO: 265436 - DNA, 842 bp, Homo sapiens
  misc_feature: GYAE6OF01ANVF5.34.26.C04.1.454.CMB.1.raw
  modified_base (181)..(181): a, c, t, g, unknown or other
  misc_feature (181)..(181): n is a, c, g, or t
  modified_base (268)..(268): a, c, t, g, unknown or other
  misc_feature (268)..(268): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatgggagtttgggctgagtcgttgggttttcctgttcgcttcttttaagnggtgtccagtgtcaggtgcagcgtgggtcggagtcggtgggggacgtcggtccggcccaacggcccggtacggggtacccgttcccnggaacgtacccttccgttccgtaggtcgacacggtccggttcgtacggtaacttccctaccgtttcgaagggtttactacgtagttccgggactaggttcgtccgtacggtcccgggtccaccggaggtaccgtccggagggttacggaaccggggtgtacgggttaggtcgggtagcttaaggttacagttgggtatacggtagtaagggtaacgtacggtactaaataacggttagcggtaacctacgggtaaccgttaccggggtacggtaacgggtaaccggttacgttaacccgtaccccggttacctaaccggtaacggaaacccggtaaccgttaaaacccgtaacccgtaaacgaaacccgttacggtaccgttaacggttaacgtttaccgtaaacggtaactaaaccggtaccgtaaccgggacctacgggtaaccgtaaggacccgggaaccgaaacgggtaccggtaaccggtttaacgtaacgtttaaccggttacgtacgggtttaacggacggttaacggaaacggtacgaaacggtccaaaccggtccgtaaccgggg

SEQ ID NO: 265437 - DNA, 765 bp, Homo sapiens
  misc_feature: GYAE6OF01DTJO5.34.26.C04.1.454.CMB.1.raw
  modified_base (181)..(181): a, c, t, g, unknown or other
  misc_feature (181)..(181): n is a, c, g, or t
  modified_base (746)..(746): a, c, t, g, unknown or other
  misc_feature (746)..(746): n is a, c, g, or t
tcagtacacgtgatcacgaccggtgctcgatttagtctagcgactttgggtttggggctgggagaggagcccagcactagaggtcggcggttgtttccattcggtgatcagcactgaacacagaggactcacagtggagtttgggctgagtcttgggttttcctcgttgcttcttttaagnggtcgtccagtgtcaggtgcagtcgtggtggaggtcggtggggggacgcggtcggcccgaggtcccgtggggaccttcccgtagacgtaccttcgtccgtggtcgaccgtaacggtccgttacgttggttacctttacctaacccgttttcgaacgttacgtccgtaggttcggactagtcggtacccgtaccggttcggggtccccgaccgacgggtcccttaccggagggtacccggaagggggtcgtaggggtacggtggggtacgtacgttaaggttttagtaggttggttaagtgggttaagtaagggttaaagttacgtaactaaagttacttagtgaaccgacgtaccggtccggtaacgggaccggtaccgttacttcccgaccgtaccgtacgaaggtaaccaacctaacgtaaccccgaaagaaccgtcgttacttacgttacgtccgtaacgaacctaaacggtccgaaccgtacgtaccgtaggacggaccgacccggaagtaaccgacggttactacgttaggttacttacgtggtacgacggaagacgganaacgcccggaccgttacgg

SEQ ID NO: 265438 - DNA, 778 bp, Homo sapiens
  misc_feature: GYAE6OF01EC68B.34.26.C04.1.454.CMB.1.raw
tcagtacacgtgatcacgaccggtgctcgatttagtctagcgactttgggtttggggctgggagaggagccccagcactagaggtcggcggtgtttccattcggtgatcagcactgaacacagaggactcaccagtggtagtttgggctggagcgttgggtttttccctcgtttgtcttacgttttaaggaggtgtcctagtgtcgaggtgcgagtcgtggtggtaggtcggtgggggaggcggtcggcccacggccgtcgggaccgtcccgtgacgtcctcctcgtgtcgcgagtccgttcgtaggtacttcctaccgtttacgagttacgtacgagttggctagtcgccgtacggttcccgggtccgacccggacggtaccgtccggaacgggaccggtaaacgggggtcgttaggggtacggttggggtacgtacgttaaaggtttagtaggttaggtagtaggtaagtaggtaaagttacgtaactaatacgttagtcgtacgtacggtaccgttacgggtacggaacgggttccgtaactttcccgtacccgttaccgtaaccgaaggtaacccgaaccgtaaccgtaacccgaaacgtaacccgtcgtacgttagtacgttactaacgtaaccgaaacgtaccgtaaccgtacgtaaccgtacggacgaccggtacggacggtaaaccgcgttaacgttacgttggttaactttaggaccggttacgaacggtaaccggaacggtaaacgacccgtaccgtaccgtaccggg

SEQ ID NO: 265439 - DNA, 815 bp, Homo sapiens
  misc_feature: GYAE6OF01DVJJ3.34.26.C04.1.454.CMB.1.raw
  modified_base (625)..(625): a, c, t, g, unknown or other
  misc_feature (625)..(625): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggtagtttgggctgagcgttgggtttttcctgttgcttacgttttaagaggtgtccagtgtcgaggtgcagcgtggtggagtcggtggggacgcgtcggcccagcccgtgggacctcccgtagacgtaccttccgtccgtgtcgaccgaggtccgttcgtaggtactttcccgtaccgtttcgtaagttacgtacaggtcggacaggttcgaccgtaccggtccggggtcccaccggtaggcccgtccggagggaccggaagggtcgtaggggagttgggggctacgttaaggtttaataggtaggtaacgtggtagttacgggtaaagttacgtaacctaaaagttccttaggacgtaacgtaacgggttacccggttacgggtaacggggtaaccgggtcccgtttaacgttccccggtaacccgtttaccgaaccgtaaggtaaccggaaaccttaacccgtaaccgaaaacgtaccctaacccggtnttaaccgttactaacgtacgaaaccgtaacgtaccggaaccgtactacgggtaacgacccggaacgggtacccggtaacggaccgttaaaccggacgttttaacggttaacgttaaccggtttcggtaggaaccgggaacggtaaaagggaacccgtaaaggtacccgaacccggttaaccgacccgggg

SEQ ID NO: 265440 - DNA, 976 bp, Homo sapiens
  misc_feature: GYAE6OF01AB8KC.34.26.C04.1.454.CMB.1.raw
tcagtacacgtgatcacgaccggtgctcgatttagtctagcgactttgggtttggggctgggagaggagcccagcactagaggtcggcggtgtttcccattcggtgatcagcactgaacacagaggactcaccagtggagtttggctgacgtcgttgggttttccctcggttgcttacgtttttaaggaggttcgtaccagttcgtccgtaggtcgacaggtcgtagggtcggacggtcggtggggggacggtcggtccggacccgaggtccggtacggggtaccgtcccgtaggaaccgtccgttccttccgtagtcgaccgtacggtccggtttacgtggttaacctttaaccccgtaccgtttaacgtaaggtttaaccggtaccgtacgggttcggaaccttaggttacccggacgttaaccgggggttccgggtacccccaacgggtacgtcccggtaaccggtacggggtaacgggaacgggggttgtacggggggtcgggttacggggttaccgtaggtttaacggtttaacggttaacgggttggtaacggtaaggttagggttaaacgggtaaacgtttaacgtaacgttaaacgtacgtttaaggccggtaacctttacggtaaccgggtcgggtaacggaccgggttacccgttaacgtttaccccggaccgttacccgtaacggtaacgtaacccgtaaacccgtaacccggtaaacccgtaacgtaaaccccggtaccggtttcgttaaacccgttacgtttaacccgaacgtaaacccgttaacggacccgtaacgggtacccgttaagacccgggttaacggaacccggggtaccggttaaacggacccggtttaaacccggttagggtttacttacccggttaaagggtcggttacccggaaaaggtacgggttaaacccgaaacgtacccggtaaacgtccccggaaacgtttaccggg

SEQ ID NO: 265441 - DNA, 776 bp, Homo sapiens
  misc_feature: GYAE6OF01DBK9T.34.26.C04.1.454.CMB.1.raw
tcagtacacgtgatcacgaccggtgctcgatttagtctagcgactttgggtttggggctgggagaggagcccagcactagaggtcggcggttgtttccattcggtgatcagcactgaacacagaggactcaccagtggagtttgggctgagcgttgggtttttcctcgttgcttacgttttaagaggtcgtccagtgtcaggtgcaggtcgtgggtggacggtcggtggggggacgtccggtcggcccgaggtccggtcggggaccttcccgtaggacctaccttcctccgtggtcgccgtagtccggttcgtggtaccttaccgtaccttagacgttagcctaagtccggctatcggctacggtcgggtcccaccgacggtctacccggagggaccggtaagggcgtagggtagggtggggtacggtacttaggttaaggtaggttagtaaacgtggtaaagtacgggttaaaggtacgttaacgtaaacttacgtaaggtcgacgttaacgtaccggtcgtaacgggaacggtaccgtacgttacccgttaccgtaccgtaaccgaacgtaacgtaaccaaccgtaacccgtaaacgaaccgtaccgtactaacggttactaccggtaacaaccgtaacgtacgaacccgacgtaccgacggaagggtacccgaaccgggtaaccggaccgttaaccggacgttaaaccgtggttaaccgttacggtggtaacgggtacggaacgaacggtacgaacccgccgaccgtaaccgg

SEQ ID NO: 265442 - DNA, 793 bp, Homo sapiens
  misc_feature: GYAE6OF01D8ZOH.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggtttttccctcgtttgcttacgttttaaagaggtgtccagtgtcaggtgcagcgtggtggagtcggtgggggaggcgtcggcccagcccgtgggaccgtccctgacgacctctccgtgtcgcagtcgtcgtggtacttcctaccttcgtaagtcgtcagtggcagtcgcctaccggttccggggtcccgcccggtacggcccgtaccgagggtaccggaaggggtcggtaggggtacgggttggggtcggtacgtaaggtttagtaggtttaggtagttggaagttagggtaaacgttacgtaactaaacgtttattaaacgtggaaccgttacggtaacccgttccgggtaagggtaaccgggtccgttacgttcccgtacccgttacccgtaccgaacggaacgtaacccaaccgtaaccccgaaacggtaacccgtaaccgtacgttaaccgttacgttacgtaaccgtaaccgtaaacgttaacccggaacccgtaccggtaccgttacggaacgggtaacccgggaccccggaacggacccggtaaccggtcgttaacgttaacggttcgtttaacgtcgggttacgaccgggtaacggaacggaaccggacccgaccgtccggtaaccggg

SEQ ID NO: 265443 - DNA, 799 bp, Homo sapiens
  misc_feature: GYAE6OF01CCTAO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtcggtggagtcgtgggggagcgtcggccgagccgtgggacctcccgtgacgtactctcctggtcgacagtcgtacgtggtacttaccgtaccttcgtaaggtagttcgtagttcggcctagtcggtacctacggtcgggttcccacgtcgggtccctaccgaagggtacggaagggtccgtagggtaacgggtggggttacgcgttaaggttactacgtgggttacaggtaagtaacgggtaagttacgtacaaacgtttgtagtacggaccgtaaggtcccgttaacggtagggtaaaccgggtcttaaccgttcccgtaaccccgttccgtaaccgtaaaggtaacccgaacgaaacccgttaaccgaaaccgtaaccgtaccgtacggtttacggtaacctcggttaccgaaaactaacggtaccggtaaccggaaccgttcgtaacgggtaccggaaccgggtttaacccgaacggggtaccccgtaaacgggtttcgtaaacggtttaccgggtttaaacttccgggtggttaaaccccggaacggttaacggaacgtaacccggtaccccgtaaacgtaccgtaacccgggg

SEQ ID NO: 265444 - DNA, 729 bp, Homo sapiens
  misc_feature: GYAE6OF01BB716.34.26.C04.1.454.CMB.1.raw
  modified_base (569)..(569): a, c, t, g, unknown or other
  misc_feature (569)..(569): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttggctgagctgggttttcctcgttgcttcgttttaagaggtgtccgagtgtcgaggtgcgagcgtggtggacgttcggtagggggacggtcggtcgggaccccgtaggtcccgtcggggaaccgttcccgtggtacgtaccttcctccgtgtgactacgcggtctaggtactttcctaccgttacgaggttacgtcgtagtccgggtcagttccggcgtaccggttcgggtcccgcccgaggtcccgtaccggaagggaccggaacggggtcgtaggggtacgggtacggggttggaccttaaggtttagtaacgttagggtagagggtaagttagggtaaattacggtaactaaatacgtacgtacgacgtaacggtaccgttacggacgggtaacggacccgttagtaccgtccccgtacgaccgaanaaccggtaacgaaccctaaccgaacgtaacgaccgtgtacgtacgtctacgaacgtacgtacgtacctaacggctaaggaccggacgtacgggaactcgaggtaccgtgttagtaacgttgcgtaggtaaccgagtaaccgagaacgtcccgcggtaacg

SEQ ID NO: 265445 - DNA, 764 bp, Homo sapiens
  misc_feature: GYAE6OF01BXBQ8.34.26.C04.1.454.CMB.1.raw
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagccccagcactagaggtcggcggtgtttccattcggtgatcagcactgaacacagaggactcaccatggagtttgggctgagctgggtttctcgttgcttcttttaagngtgtccagtcgtnaggtgcagtcgtggtggagtcgtgggggaggcgtcggcccaaggtcccgtgggtccgtcccgtggacgtaccttcctccgtgtgaccgagtcgtcgtggtacttcccgaccgttntacgttagtcacgttgggcctagtaccgtccgtaccgggtttacccgggcccgaccgtacggtcccctaccgggtacggggaacggaacgggtcgtaggggttaggtcgggtacggtcgttaaggttaagtacgtaggtatacggtaggtaggtaaggttaacgagttaaacgtacgtagtcgtacgaacgttaccggtccggtagggtaaccggtcgttaaccttacccgtaacccgttccgtaacggtaacgtaacgggtaaaccctaacccgtaaacccgaacgtaaaccctacggttaacccgtacgttactaccggttaacgaacccgtaaagtacccgtaacgaaccgttacgaaccggagtaccccgggacgtacggaccgtaacccgtgttaacgttaggtacggttacgttacgacggtacggaagtacgacgactaacgcccgtaacgg

SEQ ID NO: 265446 - DNA, 798 bp, Homo sapiens
  misc_feature: GYAE6OF01C199M.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgttgggttttcctcgttgcttcgttttaaaggacggccgtccgaggtgtcgaggtcgcgagcgtgggtggtaggtcggtggggggacggccggtcggcccgaggtcccggtacggggaccgttcccgtaggacgtaccttccgtccgtggtacgccgaggtccgttcgtacggttacttcccgtaccgttacgtacgttacgtcgtagtcggtactaacgtcggtaccgtacggttccgggtccccgacgaccggtccgtaccgggacgggtaccgggaaaggggtccgtaggggtacgggtcggggtacgtacggttaagttagtaggttaggttagtaggtaacgtaagggtaaagttaacgtacgttaaacgtacgtacgtacgaacgtacggtacccgtcgggtaacggaacggtccgtaacgtacccgtaccgtaccgtacgaacggaacctaaccgaaccgtaacccgaaaaccgtaaccgtaccgtacgttacgtaaccgtacgtaacgtaaccgtaacgtacccgacgtaaccgtcgacggacggaccgtaccggtaggaacccgtacgtacgttacgttacgtaacgttcgcgggtaacggacggtaacggaagaaccgacccgtaaccgccgtaaccgg

SEQ ID NO: 265447 - DNA, 874 bp, Homo sapiens
  misc_feature: GYAE6OF01B92TR.34.26.C04.1.454.CMB.1.raw
  modified_base (105)..(105): a, c, t, g, unknown or other
  misc_feature (105)..(105): n is a, c, g, or t
  modified_base (233)..(233): a, c, t, g, unknown or other
  misc_feature (233)..(233): n is a, c, g, or t
  modified_base (643)..(643): a, c, t, g, unknown or other
  misc_feature (643)..(643): n is a, c, g, or t
tcagtacacgtgatcacgaccggtgctcgatttagtctagcgactttgggtttggggctgggagaggagcccagcactagaggtcggcggtgtttccattcggtnatcagcactgaacacagtaggactcaccatggtagtttgggctggacgtcgttcgggttttcctggtttcgctttacgttttaagacggttcgtccgtaggttcgcgtagggtgaccgaggtcgtggnggtacgtcgggtggggggacgtcgtcggaccctaggtccgtcgggtaccttcccgtaggacgtccttaccgtccggtggtacgccgtaggtccggttacgtacggtaccttcccgtaaccctttcgtaacggttagtcaagttcggcacgtccgtaccgtaccgggttccggggccctaccgaacggtccctaccggaagggccgggtaagggtccggtagggtacggttcggggtcctaaggtttaaccgtttagttacgggtacggtaagttacggtaaggtacggggttaaacgtttaggtaacctaaagttttacgtaaggaccggttaacgtaaccggttaaccgggtaccggggtaaggggtaaaccggtccgttaaccggtttaccccgtaacccgggttacncggtaaaacggttacccgaaacccgtaaaccggttaacccgaaacgtaccgtacgggtacttaacggttaactcgtaacggtaaaccttacggaaaccgttaccgtacggacgtaacggggtaccgtaaccgaccgggttaaaccggtcgaaaacccggttcgttaaacgttcgttaacgttcggtcggtacgaacggttagaacggtacaacccggtgtaaccggtacgg

SEQ ID NO: 265448 - DNA, 767 bp, Homo sapiens
  misc_feature: GYAE6OF01A5VGJ.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagtcgttgggttttcctcgttgtcttacgtttttaagaggtgtccagtgtcaggtgacagcgtgggtaggtagtcggtggggggaggcggtcggccccgaggtcccgtgggaccgttcccgtgacgtacctccgtaccgtgtcgctagcgttcgtggtacttaccgtaccttagaagttacgtactagttggctagtcgactcggtcgggtcccgaccgacggtcctaccggagggtaccggaagggggtcgtaggggtacggtaggggtcgtacgttaggttagtaggttaggtagtacgtaaggtaggttaaacggttataactaaacgttacgttaagtaccggtacgaacgttaccggttaccggtaacgggtaccgggtaccgttaacgttaccgtacccgttaccacggtaacgaacgaaacccgttaccgtaaacccggaaacgtaaccgtaccgtaagttccgtaacgtacgagtaactaaccggacgtaacctacgtaccgtacggacggaccgtaccggacgtaccggtacgtacgttacgttaggttacgtttaggacggtacggaaggtaacggacgtaaccggaacgttcccgaacccgttaaccggg

SEQ ID NO: 265449 - DNA, 688 bp, Homo sapiens
  misc_feature: GYAE6OF01DJP8Y.34.26.C04.1.454.CMB.1.raw
  modified_base (183)..(183): a, c, t, g, unknown or other
  misc_feature (183)..(183): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
  modified_base (378)..(378): a, c, t, g, unknown or other
  misc_feature (378)..(378): n is a, c, g, or t
tcagtacacgtgatcacgaccggtgctcgatttagtctagcgactttgggtttggggctgggagaggagccccagcactagaggtcggcggtgtttccattcggtgatcagcactgaacacagagactcaccagtggagtttgggctgagcgttgggttttccctcgttgcttacttttaagnggtgtccagttgtcaggtgcagctgggtggagtcgtgggggagcgtggccccagccgtggggacctccctgacgtacctcgtctgcgcagtcgtntgactctacttcagtgtnagtgcatgcgacggtcggccgcaggcctccgagggcgaagggcgtgggaggttcgggtggtacaaggtttatagtgggttanaggtagtaaggtaaacgtagttaacgaagtttaactaggcgtacgaacggtacgtaccggtaggacgggtaccgtaggttaccctacccgtctccgaaacgaacgaaccaacttacccgaaaacgtaacgaaccgttcgaacggttacttcgtaaccgtaacttaaacggacccgtaacgtaaccgtcttaacggaacggaccgggtaccggtaaacgggacccgtaaccgggtaccttaacggttaggttaacgttccggttggtaaggaccgtaaggtaaacggacgaacgaccgttacccgaaccgg

SEQ ID NO: 265450 - DNA, 735 bp, Homo sapiens
  misc_feature: GYAE6OF01CZL24.34.26.C04.1.454.CMB.1.raw
  modified_base (205)..(205): a, c, t, g, unknown or other
  misc_feature (205)..(205): n is a, c, g, or t
  modified_base (365)..(365): a, c, t, g, unknown or other
  misc_feature (365)..(365): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgacacagagactcacatggagtttgggctgagtcgttgggtttttccctcggttgacctttcgttttaaaggagggtgtcccgagttggtnacgggtgcgagtcgtgggtaggacggttcggtggggggacgcggtggccccaggccgtaggggcctcccgtgacgtcctctcgtggtcgcaggtcgtcgttggtactttccgaccttgtaacgtagtcaagttggcctaagtcgcctacggtcgggcccnccgacggccctaccggagggcgtaaggggcgtagggcggtggggtncgtaagtttacgtagtgggtatgtaaggtaggtaactacggtactaattacgagtgaccgaagtaccggtacggtacggaacggtccgtacgtaccgtaccgtaccgtacgaacggtaactaaccgtaaccttaacccggaaacgtaacgtaccggtacttacgtaacctttcgaaccgtaataaccggtacgaaaccggttcgaccggtaaaggccggaaccgggaacccggagtaaaacccggtcggttaaacggttacgttaggtttaacgttacggtcgtaacggtacggaacggtacggactacgacgtcgtaaccggg

SEQ ID NO: 265451 - DNA, 813 bp, Homo sapiens
  misc_feature: GYAE6OF01BD7GH.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcgttgggttttcctcgttgcttacttttaaggaggttcgtccagttgtcaggtgcagtcgtgggtggaggtcggtggggggaggcggtcggcccaggtcccgtggggacctcccgtggacgtcctccgttccgtggtcgccaggtccgttcgttggtactttcccgtaaccccttttacgaaggttacgtccgtagtcgggactagtcggaccgtaccgggttccggggtccccgacccgaagggtccctacccggaacgggacggaaacggggggtccttagggggacgggtttgggggtacggtaccgttaagggtttaagttaacgggttaggggttaattacgggaaggtttacggggtaaaacggtttaacggtaactaaacgttttaccgtaagttacggacctaacggtccccgtacggtaacggtaacgggtccgtaacgttcccgtacccgtacgtaccgaagaaccgaaccgtaactaacccgaaacgtaaccacggtccgttagtacgtactagaacctaacgtaccgtaccgacgtaccgtaacggacgtaccggaccgtacggaaccgaccgtaacgttcgttagttaacggtttaaccgcggtaacggacgtaaacggaacggtaacgaaccggtaccgtacccgtaacgg

SEQ ID NO: 265452 - DNA, 716 bp, Homo sapiens
  misc_feature: GYAE6OF01EM04O.34.26.C04.1.454.CMB.1.raw
  modified_base (92)..(92): a, c, t, g, unknown or other
  misc_feature (92)..(92): n is a, c, g, or t
  modified_base (187)..(187): a, c, t, g, unknown or other
  misc_feature (187)..(187): n is a, c, g, or t
  modified_base (369)..(369): a, c, t, g, unknown or other
  misc_feature (369)..(369): n is a, c, g, or t
  modified_base (709)..(709): a, c, t, g, unknown or other
  misc_feature (709)..(709): n is a, c, g, or t
tcagtacacgtgatcacgaccggtgctcgatttagtctagcgactttgggtttggggctgggagaggagcccagcactagaggtcggcggtntttccattcggtgatcagcactgaacacagaggacctcaccagtgggtagtttgggctgagtcgttgggttttcctcgttgcttacttttaaggnggtgtcctaggtgtcaggtgcaggtcgtgggtggaggtcggtggggggtagcggtccggccaggccgtgggaccttccgtgacgtactcctcgtagtcgctagtcgttctggtacttccaccttcgagtactctaggtagtcatcgccgtacgggtccgggtccgccgacggtcctaccggngggacggtaggggccttagggtacgggtgggtcggtacgttaaggttagtaaggttgtaagggttagaaccgggttaagggtaagttaccgtaagtaaacgtcgttagacggtacaacggttcgttaccgggtaacggaccgggtaccttacgttaccgtacccgtaccgtaccgaggacctaactaccgtaaacccgactaaccgtacgttcgtaacgtactacgacggtaacacgtaccgtaccgtcggtacctaggaccgtacggaaccgggtacgacccggtagtaacttggttacgttacgtacggtcgtagaacggtacaggtacggctacggntaccggg

SEQ ID NO: 265453 - DNA, 863 bp, Homo sapiens
  misc_feature: GYAE6OF01BGAOA.34.26.C04.1.454.CMB.1.raw
  modified_base (166)..(166): a, c, t, g, unknown or other
  misc_feature (166)..(166): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (203)..(204): a, c, t, g, unknown or other
  misc_feature (203)..(204): n is a, c, g, or t
  modified_base (270)..(270): a, c, t, g, unknown or other
  misc_feature (270)..(270): n is a, c, g, or t
tcagtacacgtgatcacgaccggtgctcgatttagtctagcgactttgggtttgggggctggggagaggagcccagcactagaggtcggcggtgtttccattcggtgatcagcactgaacacagaggactcaccatgggagtttgggctggagcttgggttttccncgttgcttattttaagnggttntccaggttgcaggtnnacgcgtgggtagggtagtcggtgggggggacgtcgtacggcccaggcccggtggggaaccttccgnggactactctccgtgtcgcgacgtccgtagtcggtacttacccgtaacccttgtaacggttcgtaccgaggtcgggtacctaaggttcggcccgttaaccgggttccggggaccccgtacccgtaacgggcccgtacccggaccgggacggggtaacgggggtcggttacgggggtaagggttcggggtaaggtaacgttagtttaaggttaaggttgggtaacgttacgggaagggtttaaaggttaacgttaacggtaaaccttaaagttacccgttaaagtccggaaccggttaaccggtaacccgggtacgggtaaccgggttaacccgggtaccgtttacccggtttaaccgaaccccgtttaccgaacccggaagtaaccgtaacccgtaaacccctaccgggtaaaacgtacccgtacgtacgtttacgtacgtaacggttcaaacgttaccggtacccgtaacggtacgtacgtaaggaccggaaccggttaaccgggaacgtaccgtacgtacgttaggtacttaccggtcggttaggaccgttacggaaacggtacggaacctacgtccgaccgttaaccggg

SEQ ID NO: 265454 - DNA, 753 bp, Homo sapiens
  misc_feature: GYAE6OF01DVJWC.34.26.C04.1.454.CMB.1.raw
  modified_base (243)..(243): a, c, t, g, unknown or other
  misc_feature (243)..(243): n is a, c, g, or t
  modified_base (650)..(650): a, c, t, g, unknown or other
  misc_feature (650)..(650): n is a, c, g, or t
  modified_base (742)..(742): a, c, t, g, unknown or other
  misc_feature (742)..(742): n is a, c, g, or t
tcagtacacgtgatcacgaccggtgctcgatttagtctagcgactttgggtttgggctgggagaggagcccagcactagaggtcggcggtgtttccattcggtgatcagcactagaaccacaggaggacctcacctagtgggtaggtttgggctaggtacgtccgttttcgggtttttcccttcggtttgtccttttacgtttttaaaggcggttcgtaccgtaaggttcgtccgagggttcncgtagtcggttgggtaggacgggttccggggtggggggacggtccgggtccggaccccgtacggtcccggttacggggacccgttcccgaggaccgttaccttccgtccgttagtcgtaccgaggttcccgttagtacggttacctttcctaccgttacgtaggttactacgtacgtgacctagtaccgccgttccgggtccgggtcccacggtacggcctacggagggacgtaggggcgtgggtggtggtcgtagttagttagtagttagtagtacggaaggttacggtaatagttaccaagttactgtacgacgtaacgtccggtacggtaacgggaccgtccgttactcccggtaccgtacaaccgtaacgaccgacctaaacctacgaacgtacgtcgtactntactacacgaactacgaccacggtcaccgagaccggcggacgaagcccgtaggtatacgttagtacgtggagccgaagtacggataccgacncgtacgtacgg

SEQ ID NO: 265455 - DNA, 785 bp, Homo sapiens
  misc_feature: GYAE6OF01CLPCN.34.26.C04.1.454.CMB.1.raw
  modified_base (310)..(310): a, c, t, g, unknown or other
  misc_feature (310)..(310): n is a, c, g, or t
  modified_base (464)..(464): a, c, t, g, unknown or other
  misc_feature (464)..(464): n is a, c, g, or t
  modified_base (579)..(579): a, c, t, g, unknown or other
  misc_feature (579)..(579): n is a, c, g, or t
tcagtacacgtgatcacgaccggtgctcgatttagtctagcgacttttgggtttggggctgggagaggagcccagcactagaggtcggcgttgtttccattcggtgatcagcactgaacacagaggactcacgagtggagtttggctgagtcgttcgggttttcctcgtttcgctttacgttttaaggaggttcgtaccgagttgtacgaggtcgcaggtcgttgggtggaggtcggtaggggggcggtcggtccggacccgaggtccgtaccggggtcccgttaccgaggtaaccgtcctttccgtcgnggttcgaccgacggttcggttaccgtaggttcctttaaccgttaccttaggtaacgttaccgttcgtaagttcggactagtcgtacgtccggtcgggtcccggaccgacgtccggtaccggagggacggtaagggtcggtgggtacggtagggnggtaaccgttaggttaagtaaggttaggtacggttacgaggttaagggtaagttaacgtaagtaaacgtttaccgtagtaccgacgtacgtacgtaacggacggtacgccgttanccctacgttacgataacgagtaacaacgaccgtaaacgacgttaaccgctttaagtaccgtaagtactaacggtacctacgggaacgttaccgccggtaggaacgccggaaacgggtaccggtaaaccggcgttaaaccgtaggtttacttaacggttacgtcggtaaagcgaacggagaaccgaaccgtacggtacccggaacgg

SEQ ID NO: 265456 - DNA, 905 bp, Homo sapiens
  misc_feature: GYAE6OF01D0NO0.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcacagtggagtttggctgagtcgttcgggttttcctcgttgcttacgttttaaggaggtcgtccagtgtcaggtgcagcgtgggtggacgtcggtgggggaggcgtccggacccaggtccggtcgggaccttcccgtgaccgtacctcctccgtaggtcgaccgtagtccggttacgtggttaacctttcctaccgttacgtaaggttccgtacagttcggaacctagtcgaccgttaccgggttccgggacccccgaccggtaacggtccctaacccgggaaggggtacccggtaacgggggttcgtacggggaggttacgggggtcgtaacgttaaggtttaacgtaggtttagggtataggtaaaccggtaaggttaaacgttaggttaacccttaaaagttaccgtaaggttaccaacggtaacccggttaaccggttaacccgggtaacgggtaaccgggttaccccggtaaccgttcccggtaacccttacccgtaacgaacggaaacccggtaaccaaacccgttaaaccggaaaaccgacccggttaacgtaacgttcgtaaaccgttccgtaacggtaacctaaaccggttaccgaaccgttaaccggccggtaacggaccgggtaaccgggaaccccggtaacggaaccccggttacgggtaaacctttacgggttaccggttaaacggtttacccggttaagtaacccgggtaaggaaaccgggtaacgaaccggaacccggtaacccgacccggtaaacccgggg

SEQ ID NO: 265457 - DNA, 739 bp, Homo sapiens
  misc_feature: GYAE6OF01D0EH1.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttccctcgtttgcttcttttaagaggtgtccagtgtcaggtgcagctgggtggagtcggtgggggagcgtggccccagccgtgggacctccctgagcctctcctggtgcagtcgtctggactttccaccttcagttagtcagtggccatcgactacgttcggggtcccgccgacggcctaccgagggaccgaaaggggctagggaggtcggggtggctagttataggtcggttatggtagtagggaagtcgtacgtaatacgtatcggacaacggtacgttaccggtagggaaaccggggtccgttaacgtttacccggaaccccgtttaccgtaacccgaaaggtaacccgtaaacccgtaaaccttaacccccgaaaacgtaaacccggtaccgttacgttaccgggttaacttccgaacggtaacctaaaacggtaccgaaccgtaaccggcccgtaaggacggaccggtacccgggaaacggacccggtaacggtaccttaaacggttagttaacgtttacccggtgttaacccggaggtaacgaaagggacccgtaacgaccgtcccgtaaaccgg

SEQ ID NO: 265458 - DNA, 869 bp, Homo sapiens
  misc_feature: GYAE6OF01ANSOC.34.26.C04.1.454.CMB.1.raw
  modified_base (202)..(202): a, c, t, g, unknown or other
  misc_feature (202)..(202): n is a, c, g, or t
tcagtacacgtgatcacgaccggtgctcgatttagtctagcgactttggggtttggggctgggagaggagcccagcactagaggtcggcggtgtttccattcggtgatcagcactgaacacagaggactcaccatggagtttgggctgagcttgggttttcctcgttgccttctttttaagaggttgtccagtcgtcaggtncagctgggtggagtcgtgggggacgcgtcggcccagcccgtgggaccgtccctggaacgtaccttcgtcctggtcgcgtacggtccgttctgggtacttccgtaaccttcgagttaacgtcagtcggctactgtacctcggttccgggtccctaaccgaggtccctaccggaacggtaccggaagggggtccgtaggggtacggttcggggtacggacgttaacggtttaacgtaggttacgggttaagtacggttaacgggttacggggtaaacgttacgttaacgttaaacgtttaaccgttaacggttcggaacgttaaccggtaccggttaccgggtaacgggtaaaccggggtacgttaacccgttacccggtaaccccgttaccgttaacccggaaacggtaaccgaaacccgttaaacccgtaaaccccgaaaacggtaaacccgttaacccggtacgtttacgttaaccgttacggttaaaccgaaccgttaaacggtaccgaaaccggacggtaccggtacgaaccggaaccggggtaaccggaacggtaccggtaaccggtacttaacggtttaacgttaaacgttaccggttaacgggtacggaacccgggtaacggtaaccggtaaaggacccgtaccggtacccgttaaccggg

SEQ ID NO: 265459 - DNA, 869 bp, Homo sapiens
  misc_feature: GYAE6OF01BALH6.34.26.C04.1.454.CMB.1.raw
tcagtacacgtgatcacgaccggtgctcgatttagtctagcgactttgggtttggggctgggagaggagcccagcactagaggtcggcggttgtttccattcggtgatcagcactgaacacagaggactcaccatggtagtttgggctgagcgttcgggttttcctcgttcgtcttcttttaaggaggttgtaccaggttcgtcaggtgccgtagcgtgggtcggtaggtcggtggggggaggtccggtcgggaccccgagtccgtgggtacccgttccctggacgtccttccgttcctagtcgcgtacggtccgttcgtacgggtaccttccgttaaccccgtttgtacggttacggaccgtaagtcgggactaggtcgtccgtaaccgggttccggggtcccgaccggtcggtcccgtacccgggaagggtcggaaccggggtcggtaggggtaggttgggtacggtacgttaggttaacggtgttgggttaagtaggttaagtaccgggtaaaagtttacgtaaccctaaaaggtttcctaaggtcgtaacgtaaccggttcccgtaaccgggtaggggtaccggtaccttacctaacccgggttacccgtaacctaacggaagtaacccgtactaaacgaacccggtaaaccacgtacgttacgtacgtacttacgacgtaactaaccggtcccgaccgttaaggtaccgtacgggaaccggtaaccgggtacccggaaaccgggttaccgacggtttaaccgttaattaaccccggggttacttaacgggttaggtaccccgggaaacggtttaaggggaaccgttaaccggaacccggaacggtaccccgttaaaaccggggg

SEQ ID NO: 265460 - DNA, 761 bp, Homo sapiens
  misc_feature: GYAE6OF01DRZNX.34.26.C04.1.454.CMB.1.raw
  modified_base (189)..(189): a, c, t, g, unknown or other
  misc_feature (189)..(189): n is a, c, g, or t
  modified_base (344)..(344): a, c, t, g, unknown or other
  misc_feature (344)..(344): n is a, c, g, or t
  modified_base (378)..(378): a, c, t, g, unknown or other
  misc_feature (378)..(378): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggtttttcctcgttgtcttacgtttttaaaggnggttcgttccgagttgtcgaggtgcagtcgtgggtcggaggtcgggtggggggacggccggtcggccccgaggtcccggtggggtacccgtcccgtggacgtaccttccgttccgtaggtgcacggtccgttcgtaggtaccttcctaccctttnaggttatcagtggacatcgcgtacgtcgggcccnccgaggtccaccggagggtcggaacggggtcgtggggtacgggtggggtgtaccttaaggtttatacggtaggttaatggtaagttacgggtaaagttacgtaactaaacgtactagttacgactacggtaccgtaccgggtaaggaccgggtaccttacgttacccgcccgttacgtaaccgaaggaccctaaacgtaacccgttaaacccgaaacgtaacgtccgtacgttacggtaacttcgaacgtaactaacgtaccgaccgtacgtccgtaaggacgacggaacccggtaaggacccgttacggtacttacggtagtttaccgtccgtagggtacggaacgggtacgaacggtacgaacccgacggtcctaaccggg

SEQ ID NO: 265461 - DNA, 689 bp, Homo sapiens
  misc_feature: GYAE6OF01EXUSA.34.26.C04.1.454.CMB.1.raw
  modified_base (204)..(204): a, c, t, g, unknown or other
  misc_feature (204)..(204): n is a, c, g, or t
  modified_base (268)..(268): a, c, t, g, unknown or other
  misc_feature (268)..(268): n is a, c, g, or t
  modified_base (387)..(387): a, c, t, g, unknown or other
  misc_feature (387)..(387): n is a, c, g, or t
  modified_base (448)..(448): a, c, t, g, unknown or other
  misc_feature (448)..(448): n is a, c, g, or t
  modified_base (647)..(647): a, c, t, g, unknown or other
  misc_feature (647)..(647): n is a, c, g, or t
  modified_base (671)..(671): a, c, t, g, unknown or other
  misc_feature (671)..(671): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcttgggttttccctgttgcttacgtttttaagaggttcgtccagtgtccaggtncagcgtgggtggagtcgtggggggagcgtcggcccagccgtgggacctcctgacgtcctctccngtcgcagtcgtcgtggtacttaccaccttgaggtatcagtcggactagtcgctacggtcgggtcccgaccgaggtcctacccggagggtcggaacggggtcgtggacgggtggggtacncttaaggtttacacggttggtagtcggaaggttagggtaaacgttagtcctaaatacgttnacggtacacgtaccggttcggaagggtaccggtactacgttacccgacgttaccgtaccgaagtaaccgtaacctaaccgtaaccccgaaagtaaccctcgtataacggttccttacgactaacgtaaccgtacggacccggtactcgggaacgacggtacccggaccggagtaaccgccggtaattcgtaaacgtttntacggtggctaacggagaaccganaccctagaccgttaacgg

SEQ ID NO: 265462 - DNA, 752 bp, Homo sapiens
  misc_feature: GYAE6OF01BYN46.34.26.C04.1.454.CMB.1.raw
tcagtacacgtgatcacgaccggtgctcgatttagtctagcgactttggggtttggggctgggagaggagcccagcactagaggtcggcggttgtttccattcggtgatcagcactgaacacagaggactcaccatggacgtttgggctgagcgttgggtttttcctcggttgcgttcttttaaaggaggttgtcctaggtgtcgaggtgcagtcgtgggtggaggtcggtgggggaggcgtcggcccaggtccgtggggtacctcccgtagacgtaccttccgtccgtggtacgctaggccggttctaggtacttcctaccgttagagtacgtccagttcggctagtcgccgtcgggttcggtcccgacgacggtacctccggaggaccggtaagggtcgtgggtacggtgggtcgagttaaggtttacgtaggttcggtagtcgggtagttagggtaaacttacgtactaaagttacgtaggtacgactaacggaccggttcggtacgggaaccgggaccttacgtaccccgtactaccgtaccggaaagtaccgaaaccgttaaccgaacccgtaaagaacccgtagttacgtaacgtatccgtaacgtaactaaaccgtaccgaacctacgggtaccagggaacgtccggtaaccggaacggtccgtaaccggttagttcggttaacgtttagtccgggtaaggtacgaccgggtaagtaaccggacgaccgtacccggcgtaaccgg

SEQ ID NO: 265463 - DNA, 712 bp, Homo sapiens
  misc_feature: GYAE6OF01D0L6M.34.26.C04.1.454.CMB.1.raw
  modified_base (160)..(160): a, c, t, g, unknown or other
  misc_feature (160)..(160): n is a, c, g, or t
  modified_base (266)..(266): a, c, t, g, unknown or other
  misc_feature (266)..(266): n is a, c, g, or t
  modified_base (376)..(376): a, c, t, g, unknown or other
  misc_feature (376)..(376): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagctcaccatggagtttggactgagcttgggttttccncgttgcttcttttaagaggtcgtccagtgtcgaggtcgcagcgtgggtggagtcggtagggggagccgtcggaccccgtaaggcccgttagggggacccttcccgnggaacgtacctccttccgtagtcgactaacggcgtccgtaggtaactttccgaccctttgaagtacgtccgaagtgggacctaaggtcgacctaccggtggggtaccccncgtacggtcctaaccggagggtacgaacggggtcagggtaacggtggggtcgagtttagtaagtagtacgggttntaggacgtaaggtaagtaacgtactaaagtactggtnacgtagtaccgttacggagtaacggcctaacgttaccgacgttacgtaccgagacgtaactaacgacccgtaaagactacgtacgtgtaacttacgaacggtaataaccgccgtaaacgacgttaccgtacggagaaccggtacggacggaaccagggttacgacttaacggtagtaccgtagtaccgggaataacggtaggaatacccgaacgtcccggtaag

SEQ ID NO: 265464 - DNA, 905 bp, Homo sapiens
  misc_feature: GYAE6OF01DCG0D.34.26.C04.1.454.CMB.1.raw
  modified_base (229)..(229): a, c, t, g, unknown or other
  misc_feature (229)..(229): n is a, c, g, or t
  modified_base (546)..(546): a, c, t, g, unknown or other
  misc_feature (546)..(546): n is a, c, g, or t
tcagtacacgtgatcacgaccggtgctcgatttagtctagcgactttggggtttggggctgggagaggagccagcactagaggtcggcggtgtttccattcggtgatcagcactgaacacagaggactcacagtggtagtttgggctggagtcggtttcggggttttcctcggtttacggtcttacgtttttaagggaggttcgtaccgaggttcggtacgaggggttnaccgaagggtcggttggggtgggtagggttcggggagggggggtacggtccggttcgggacccgtaagggtcccggttacgggggtacccttcccggaaggtacggtaccttcctcggttaggtacgcggtaggtccgtcggtagttaccttcgtaccgttagtaggtacgtctagttcggatacggtcggtaccgtcggttccgggtacccaccggacgggtacccggaccgggtaacgggaagggtaacggggtgtgggggtacggggtcgggggttacagtttaaagggtttactagggggttacggtttaagnggtaacgggttaacggtaaacggtattaacccgttaaagtaacgtttacggccgtaacggacggtttaacccgggtttacgggaacggggtaactaccggtacgttaccccggtagtaacgtaccgggaacaaaccgggttaccaaacggtaaacccgaaaggtacccgttcgtaacttttacgggaccgtaacctaacgaaacggtaccgttaacgccggtaaccttacggggagtaacccggggacctaaacggggtacgaaacccgttggttaacggttactacggggttaattccccgggtaaggtcccgaaaggtacccggaacttaaccgggtcaaccggggtcttaaacggg

SEQ ID NO: 265465 - DNA, 926 bp, Homo sapiens
  misc_feature: GYAE6OF01CJSZ8.34.26.C04.1.454.CMB.1.raw
  modified_base (92)..(92): a, c, t, g, unknown or other
  misc_feature (92)..(92): n is a, c, g, or t
  modified_base (137)..(137): a, c, t, g, unknown or other
  misc_feature (137)..(137): n is a, c, g, or t
  modified_base (796)..(796): a, c, t, g, unknown or other
  misc_feature (796)..(796): n is a, c, g, or t
tcagtacacgtgatcacgaccggtgctcgatttagtctagcgactttgggtttggggctgggagaggagcccagcactagaggtcggcggtntttccattcggtgatcagcactgaacacagaggactcaccatggngtttgggctgagtcttgggttttccctcggttgcttacgttttaaggaggtcgtaccaggttgtacgagggtcgcaggtcgttgggttagggacggttcgggtaggggggacggtccggtccgggaccccgtaggtcccggttagggggacccttcccccggtaggtaaccggtaccttcccgttacccgttagggtccgaccgtagggtccgtttaccgttaggtaaccttttacccgttacccctttaggtaaacggttacgttaccgtaaggttcggtacgtaacgtcggacccgtaacggttcccggggttaccccgaccggtaacggtcccgttaacccgggaacgggtccgggtaaaacgggggtccggtaaggggttagggttcggggttacggacctttaaaggtttaggtaggttacggtaagtaggtaagtacgggtaaaacgttgaaccgtaagttaacctaggtccgtacggtaacgttaccggttaccggtacgggtaaaccggttcccctaagttccccgggaacccgttccggttaaccgaaagggtaaaccctaacgtaaacccgttaaccccgaaagttaccccggacgttaacgttaacgtaccgttaactacgggaaacccttaagtacccggaacccgnttaaccggacgggaacgacccgggtaccgaacggtaccggtaacgttaccgttacgttaaccgttacgttaccgggtagtaaccgggaaccgtaggtaaccggaccacccggttaagaccccgttacggg

SEQ ID NO: 265466 - DNA, 685 bp, Homo sapiens
  misc_feature: GYAE6OF01B3VUE.34.26.C04.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
  modified_base (343)..(343): a, c, t, g, unknown or other
  misc_feature (343)..(343): n is a, c, g, or t
  modified_base (387)..(387): a, c, t, g, unknown or other
  misc_feature (387)..(387): n is a, c, g, or t
  modified_base (490)..(490): a, c, t, g, unknown or other
  misc_feature (490)..(490): n is a, c, g, or t
  modified_base (571)..(571): a, c, t, g, unknown or other
  misc_feature (571)..(571): n is a, c, g, or t
  modified_base (584)..(584): a, c, t, g, unknown or other
  misc_feature (584)..(584): n is a, c, g, or t
  modified_base (652)..(652): a, c, t, g, unknown or other
  misc_feature (652)..(652): n is a, c, g, or t
  modified_base (676)..(676): a, c, t, g, unknown or other
  misc_feature (676)..(676): n is a, c, g, or t
tcagtacacgtgatcacgaccggtgctcgatttagtctagcgactttgggtttggggctgggagaggagcccagcactagaggtcggcggtgtttccattcggtgatcagcactgaacacgagacggacctcaaccagtgggtaggtttgggctggagtcgttcgggtttttcctcggttgtcttactttttaaggnggttcgtcctaggtgtcgagggtgacgagtcgtgggtggacggttggtgggggggacgtccggtcggccccgtaggtcccgtgggtacccgtcccgtagacgtccttcctcgtggcgacgngtcgttcgtaggtacttccgccttnaggtagtccaggttcgctactggcctacggttcgggccccacgnggtcccaccggaggacggagggtcgtgggtaggtgggagtacttaaggttacgtaggtaggttataggtaagtacggtaaagttacgtacctaaaatgtaacngggtaacaacggtccggtaagcggacggtccgtactccgacgttccgaacagaactaccaaccgtaccgaaagccacggtntacgtactcgaanaacgtacgacgtaccgactcgtaagaccgacggcgaaaggccgtacgtacgttcgagttaacttcggnggtacggagaacggacgacgaccncggtcgtag

SEQ ID NO: 265467 - DNA, 800 bp, Homo sapiens
  misc_feature: GYAE6OF01DGW5N.34.26.C04.1.454.CMB.1.raw
  modified_base (185)..(185): a, c, t, g, unknown or other
  misc_feature (185)..(185): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (503)..(503): a, c, t, g, unknown or other
  misc_feature (503)..(503): n is a, c, g, or t
tcagtacacgtgatcacgaccggtgctcgatttagtctagcgactttgggtttgggctgggagaggagcccagcactagaggtcggcgtgtttccattcggtgatcagcactgaacacagagactcacagtggtagtttgggctgagtcgttcgggttttcctcgttgctttacgttttaaaggnggttcgtacctaggttgtacgaggtgctggcgtgggtaggcggttcggtgggggcgtccgtcggacccgtgcgtcgggacctcccgtagacgtcttctccgngtcgcgngtcgtacgtcggtccttacgtacccttgtaacggtataccaggtcgctacgtcggaccgttccggccgggtcccacggttacgccctaggacgggtacggtaccggtgggtaagggcgggttaccggggtagacgtttaagtacgtttaaggttggggtaaatgggtaaaaggttaaggtacccgtaagtttaaccgaatttaaccgtntaggacccgtttaaggacccgttacgggtaaacggacggttaccgtaacccttacccggtaccgttaccgaacgtaaggaacccaacccacgttaaacccgaaaccgtaccgtacctagttacgttacacggtactaacgtaaaccgtacgaaccgtaacggtcgaacgggacggaccggaaccgggtaacgtacccgggtattaccggttacgttaaacgtttacggttacccgtagggtaacccgtaggaaccggtaacggtaaccccagggtaccccgtaacgttaaaccgggg

SEQ ID NO: 265468 - DNA, 889 bp, Homo sapiens
  misc_feature: GYAE6OF01BWOI5.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactagaacacagaggactcacagtggagtttggctgacgtcgttcgggttttcctgttcgtctttacgttttaagggaggttcgtcctaggtcgtacgtagggtgaccgtaggtggtggggtgggtacggtcggggtgggggggacggtccggtccgggacccgtacggtccggtacgggggtacccgttacccgaggtaccgtcccttccgtccggttaggtcgaccggtacggtccgtttcggtaggttaacctttccctaaccgtttacgtaggttacgtacaaggttcggactgtaccggccgtacgggtccgtcccggacgtacggcctaacgggacggaccgggaggggtcgtaggggtcggttagggtactacggttaaggttagacggttagggagttagggtaaaggttagggtaaagttaaccgtaagttaacgtaagttacggtaacgtacggtaacccggttaagggttaccgggtaacgggaacccggttaacccggttacccgttacccggttaacccgtaccgaaacccggttaaacaaacccgggttaaacccaaaccggttaaacccgaaaccggtaaccgtacggttaaccgttaaggtttacccctaaggtaaccgtaaacgtaaacggtacccgaacggtaaccgtaggaacggaccggaacggtacggtaacggtacccgtaaggttaacgtaggttacgttacggtacgcggtaaacgggcgtaaacgacgtaccggacctacgggactaaccggg

SEQ ID NO: 265469 - DNA, 848 bp, Homo sapiens
  misc_feature: GYAE6OF01BBF2G.34.26.C04.1.454.CMB.1.raw
tcagtacacgtgatcacgaccggtgctcgatttagtctagcgactttgggtttgggggctgggagaggagcccagcactagaggtcggcggtgtttccattcggtgatcagcactgaacacaggaggactcaccagtggagtttggctggagtcgttgggttttcctcgttgtactttacttttaaggaggttcgtcctaggtgtacgaggtcgacgtagcgtgggtaggacggttcgggtggggggacgcggtacggcccgacggtcccgggtgggtaccccgtccgtagaccgtaccttccgtcgtcggtcgcgacggtccggttcgtaggtactttacccaaccgtttacgaggttaacgtcaggttcggctacggtaccggaccgtaccgggttcccgggtacccgaccggtaacggtccgtaccggaacggggtaaccgggacggggtggtacgggggtagggtcggggtagtaccggtaaggtttaagtcggtaacggtaggtagtacgggttaacgggtaaacgttaagtacgtaagttacgtaagtacgaaccgtacgggtaccggttaccgggaagggtaacccgttaccggtaccgttaccgaacccgttaccgaaacgaacgtaacccgaacctaaaccgtaccaaaaccggtacctaccggttatacccgttaatccgtaaacgttaaccggaacctaaccggaccgtaaccggttacccgaagggccgtaaacccggggcgtaaacccggactaaacccgggttactttaagtacgggttacttccgggaagaccggtaggacggaacgtaaaccgaccgcgtaaccggtaacgg

SEQ ID NO: 265470 - DNA, 755 bp, Homo sapiens
  misc_feature: GYAE6OF01CMKVS.34.26.C04.1.454.CMB.1.raw
  modified_base (596)..(596): a, c, t, g, unknown or other
  misc_feature (596)..(596): n is a, c, g, or t
  modified_base (630)..(630): a, c, t, g, unknown or other
  misc_feature (630)..(630): n is a, c, g, or t
  modified_base (700)..(700): a, c, t, g, unknown or other
  misc_feature (700)..(700): n is a, c, g, or t
  modified_base (729)..(729): a, c, t, g, unknown or other
  misc_feature (729)..(729): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggtaggttggctgagtcgttcgggttttcctcgttgtcttacgttttaaggaggttcgtcctaggtcgtcgagggtgcgtaggtcgtgggtggaggtcgggtggggggacggtcgggtccggacccgtacggtccggtacggggtaccgttcccgtaggacgtacccttccgtccgtggtcgcgtacgtcggttcgtacggtaccttccgtaacctttgaacgttacgttcgaggtcggctactcggacccgtaccggttccggggtacccaccggtaccggtccgtaccggaaggaccgtaagggttcgggaggttacgggtgggttcgggtagtacgtaaggtttgtaaggtgggtatagggtaggtaggtaacgtagtaactaagtacgtagacgaccgtacggtaccggttcgggaacgggtaccggtactaccgtacccgtaccgtacgaacggaanaacccaacgaaccaaccgaagtacccgcgtttanaccgttactcgaactacgaaccgtcgaccgacgcggaagacggaacggccgaacggtagtacgtgttaanacgtttacgttcgaggtaaggcggtaaanaccggtaaacgcccgtaacgtacccg

SEQ ID NO: 265471 - DNA, 863 bp, Homo sapiens
  misc_feature: GYAE6OF01C2XU4.34.26.C04.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcgttgggttttcctcgttgcttcgtttaagnggtgtccagtgtcgaggtncgtagcgtgggtggacggttcggtaggggggacgtccggtacggccccgaggtcccggtacggggtacccgttccccgtagaaccgtcccttccgttcccgtaggtgacctaggtccgttcgttaggtaccttacccttaaccctttagtaacggtttaacgtcctaggttacggacctagttaccggccggtacccggttccggggtcccccgtaccggaaccggtacccggtaccggaaaggggccgggtaaaccgggggtgttacggggaggggttcgggtacggtacgttaaagtttagttaaggttggttaaagttgaaacggttaggtaagttaacgttaacctaaagtttaccgttaaggaccgttacgaaaccgtttcccggtaaccgggtaacgggtaacccggtaccgtaacgtttacccggtaccccgtcgtaaccgaacggtaacctaacccgtaaacccgtaaccgaaaccgacccgtaacgttacgttaacgttcgtaacgtaccgtaaagtacgtaacccgtcgtaacgacccggtaagcggaacccgtccggggtaaacaccggtcgttacggttattaacggttacccgtttaggacgttaaccgggtgtaaaacgggacaggaaccctacgtccccgtaaacggg

SEQ ID NO: 265472 - DNA, 655 bp, Homo sapiens
  misc_feature: GYAE6OF01C56U2.34.26.C04.1.454.CMB.1.raw
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
  modified_base (539)..(539): a, c, t, g, unknown or other
  misc_feature (539)..(539): n is a, c, g, or t
  modified_base (597)..(597): a, c, t, g, unknown or other
  misc_feature (597)..(597): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctgagcgtggtttcctcgtgtctctttaagaggtgtccagtgtcaggtgcagtcgtggtggaggtcgtggggggagcgtggccccaggtccgtacggggtacctccctggacgtaccttctccgtgtacgccgagtccgtcgtaggtacttccaccttcgaggtactcgatggacntgcgtacgtccggtccncgaggtcctaccgaggaccgaaggggtcgagggtcggtgggtcggattaagttataggttcgtaagtggtaagtaggtaacgttagtactaacgttaacgtagtaggacgtacgtaccgtaccgggtaagggacccggtactacgttcccgaacgttcccgaagaagtacccgactaaacccgtaccgaaacgacctaccgtntacgtactcgtaacgaactacgtacgaccgaacgtccagggaccgtacggacccgganaacccggtgtacctaagttagtactcggtcgtagagtaccgagacaccgcgtccgtag

SEQ ID NO: 265473 - DNA, 926 bp, Homo sapiens
  misc_feature: GYAE6OF01B4B2E.34.26.C04.1.454.CMB.1.raw
  modified_base (189)..(189): a, c, t, g, unknown or other
  misc_feature (189)..(189): n is a, c, g, or t
  modified_base (263)..(263): a, c, t, g, unknown or other
  misc_feature (263)..(263): n is a, c, g, or t
  modified_base (878)..(878): a, c, t, g, unknown or other
  misc_feature (878)..(878): n is a, c, g, or t
tcagtacacgtgatcacgaccggtgctcgatttagtctagcgactttgggtttgggctgggagaggagcccagcactagaggtcggcggtgtttccattcggtgatcagcactagaacacgagaggactcacagtggtaggtttgggctgagtcgttcggttttccgtcgttcgtcttacgtttaaggnggtcgtccgaggtgtcgagggtcgcgagtcggtgggtaggtcggtcgggtgggggcggtccggtccggacccgnggtcccggtcgggacccgtccgcggtaacgtcctccgttcgtggtcgacgcgttcgttacgtggttacctttaccgtaaccgttcgtaacggttaccgtcgtaacggtcgggtaactcggtaccgtaccgtaccggggttaccccgggggtcccggaaccggttacccgggccccgtaaccggggaaggggtaacccggggtaagggggttccgggtaagggggttaccggggtggggggtttaccgtacggttttaaaggttttacggtaacggggtttacgggttaaggtaaggggtttaaacgttaaacgggggttaaacgtttaacggtaaacggttaaactttacggttaaggttccgaaacccgggtttaaacggttcccgggtttaaccggggtacgggttaaaccccgggtaccgtttaaccccggttacccgttaaccccggttaaacccggttaaccggaaccggaaaacgttaaccccgtaaaccggaacccgtaaaaccgtacgtaccgtacgttactaacccgttagaaccgtaacgtaaccggtaccgaaccgttacgtacggacggacggaccggtacgacgacgtaccgtagtacggtnttagtccgtaggaacgtcggaagacggtaacgacgttcgaccgtacgg

SEQ ID NO: 265474 - DNA, 911 bp, Homo sapiens
  misc_feature: GYAE6OF01AJAIU.34.26.C04.1.454.CMB.1.raw
  modified_base (464)..(464): a, c, t, g, unknown or other
  misc_feature (464)..(464): n is a, c, g, or t
tcagtacacgtgatcacgaccggtgctcgatttagtctagcgactttgggtttggggctgggagaggagcccagcactagaggtcggcggtgtttccattcggtgatcagcactgaacacgagaggactcacatggtaggtttggctgacgtcgttcgggttttcctcgttgcttacgttttaaggcggttgtccgagtgtacgagggtcgacgagtcgtgggtggtacggttccgggtaggggggacggtccgggtaccggaccccgtacggtccccggttagggggacccgttcccgtaggaacggtacccttccgtccgttaggtcgacgtaggtccgttacgtacggttacttacctaccgttacgaaggttacgtccgtaagtcggactacggtcgtacccgtacggttccggggttccccaccgtaccggcgttaccggccgggaacggaccggggtntaaccggggtaggggttgggcggtacgttaaggttagttgggtagttacggtaggttacgtaagggtaaggttacgttactaaacggttactacggtacgaccgtaaacgtcccgggtacgggttaacggggtaaccggtaccggtttaacgttacccccgtaaacggttcccggtaacccggtaacggtaaacggtaaccccgtaaaccccgtaaccccgaaaaacggtacccgaaccgggttacgtttaacctacggttacgttaaccgtaacctaacggggtaccctaaacggtacgttacccgggaaccggaacgaaaccccggggcgtaaccgggtaacgtaccggtaaacccgtttaggttaccggttaacgttccgggtaaggtacccggtaacgggaacgttaaccggaaacgtccgtaacccgtcccgtaaaccgggg

SEQ ID NO: 265475 - DNA, 767 bp, Homo sapiens
  misc_feature: GYAE6OF01DT2WI.34.26.C04.1.454.CMB.1.raw
  modified_base (244)..(244): a, c, t, g, unknown or other
  misc_feature (244)..(244): n is a, c, g, or t
  modified_base (753)..(753): a, c, t, g, unknown or other
  misc_feature (753)..(753): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtaggtttgggctggacgtcgttcgggtttttcctcggttgtcttacgttttaaggaggttcgtcctagtcgtcgaggtgcgagtcgtggtggaggtcggtagggggngccgtcggcccaggccgtacgggaccttcccgtagacggtacttccgtccgtggtgacgagtcgttccgtaggtaccttaccgtaccttacgtaagttacggtactagttgggacctacggttacgaccggttaccggtaccggggtaccccgaccggtaaccggtacctaacccgggaagggtacccggaaagggggtccgtaggggtaggtacgggtgtaacgtttagttaagtggtaggttactaggaagttacggaaagttcgaaacgttatacgtagttcgaaccacggttacgtaccggtaacggaccggtaccgtacgtacccgtacccgtcgaacgacgtaacaaccgtaacctaaccgaaacgtaaccgtacgtacgtaacgttacgtaacctacgtaccaacgaccgtaaccgacgtaccgtaacgtacggaaccggaacgtacggaccggtacgttacgtagttagttaccgtgtacgtggaacgaagtacgataccncggaccttaccggg

SEQ ID NO: 265476 - DNA, 887 bp, Homo sapiens
  misc_feature: GYAE6OF01B916X.34.26.C04.1.454.CMB.1.raw
  modified_base (874)..(874): a, c, t, g, unknown or other
  misc_feature (874)..(874): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcacagtggagtttgggctgagtcttgggttttcctcgttgctttacgttttaagaggttcgtccgagttgtcaggtgcaggcgttgggtggagtcggtggggggacgtccgtcggacccagtcccggttgggaccctcccgtaggaccgtaccttcctccgttggacgaccgtgttcgttcgtggtaactttcccaacccgtttcgtaggttacgtccaagttcggacctaagtcgtacccgtaaccgggttcggggtcccaccggtaacgggcccttacccggaggggtaaccggtaacgggggtcgttacggggtaggttgggggtacgtacgttaggttttaagtagggtcggttaatagggtaagtaacggggtaacgttaacgttaccgtaaaagtacgtaggtaccgtacgtaaccggtacccgttaaccgggtagggtaacccggggtaccgtttaacgttaccccgttaccccggtaccgttaaccgaacggttaacccgaaaccgtaccgttaaaccccgggaaactaccggtaaccgtacgttttaccgaccgttaacgtacccgtaaacgtaaaccggtaccccgtaacccggttaacgtcccggttaagggaccgttaacccgggaaccgggtaaaccgaaccggttaaccggttaaacgtttacgttaacggtttaacggttaacgttcgggtaagaaccgggtaaacgtaaggacccgaacggttaaccccgngttaaaccccggg

SEQ ID NO: 265477 - DNA, 864 bp, Homo sapiens
  misc_feature: GYAE6OF01C39FB.34.26.C04.1.454.CMB.1.raw
  modified_base (189)..(189): a, c, t, g, unknown or other
  misc_feature (189)..(189): n is a, c, g, or t
  modified_base (683)..(683): a, c, t, g, unknown or other
  misc_feature (683)..(683): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgacgcgttgggttttcctcgttgccttacgttttaagaggtntccagtgtcgaggtcgctagtcgtgggtggacggtcggtgggggacgtcggtcggacccaggcccgtacggggtaccctcccgtaggacgtacctttccttaccgtaggtcgacctacggtccgttcgtaacggtacctttaccgtacccctttacgtacggtacgttcaaggtcggacctagtacggaccgttaccggttccggggtaccccgccggtaacggtccccgtaaccggtaacggggaccgggaaacgggggttccgtaggggtacggggttcggggtacggtacttaacggtttaagtacggttagggttaggtacggtaaacggttaaggtaaacggttacggttaaacctaaggtttaacgacggttacggtacctacccgggttacggttaccggaaggggtaacccggtaccttaacgtttaccccgtaccccggttacgtaccggaaacgacgtaaacccgtaacctaaccccggtaaanacccggttaagtacccgtttagtaacccttcggtaacgtaaaccgtaaccgttacgggaacccgcgtaaccggtaggtacccgaacgggtacccggaaaggtccgtaacgttacgttaacgttaacggttcttaccgggagtaccggacgaaggtacgaaccgttacaccgtccctacggg

SEQ ID NO: 265478 - DNA, 852 bp, Homo sapiens
  misc_feature: GYAE6OF01C3ND4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctgagtcttgggtttttccctcggttagcttacgtttttaaaggaggttcgtccctaaggttgtcgtaggtgcgaggcgttgggtggagtccggtggggggacgcgtcggccccaggtccgtgggacctcccgtaggacgaccttccgttccgtaggtcgccgtagtccgttccgaggtacctttcctacccgttacgaagttaacgttcctagttcggacctagttacgccgttaaccggtcggggtaccccgccgtaacgggtcccgtacccggaagggtccgggaaagggggtaccgtggggtaaggggttcggggtacgtacggttaaggtttagtaggttaggttaaagtggtaaccggttaagggtaacgtaacgttaacccgaagttttaaccgtaaggtccgaacccgttaggaacccgtttacccgggttaacgggaccgggttaccgttaccgttaaccccgtaccggttcccgtacgtaaacggactaaaccgttaaaccaacccggaaacgtaacgtacccggttagttaattcccggttactaaccggacttaaacggtccgtaacccggacgtaccggttaaggacggaacccgggtacgaacgggacccgtaacccggtgtttaacgttacttagtaacgggttcgacggtaaccgtagggaacgtaacgaacccgttcgaacccttaaacggg

SEQ ID NO: 265479 - DNA, 1000 bp, Homo sapiens
  misc_feature: GYAE6OF01BB28L.34.26.C04.1.454.CMB.1.raw
  modified_base (181)..(181): a, c, t, g, unknown or other
  misc_feature (181)..(181): n is a, c, g, or t
tcagtacacgtgatcacgaccggtgctcgatttagtctagcgactttgggtttggggctgggagaggagcccagcatagaggtcggcggtgtttccattcggtgatcagcactgaacacagaggactcaccatggagtttgggctgagtcgttgggttttcctcgttgcttcgttttaagnggttgtccagtgtcaggtgcagcgtggtggaggtcggtgggggacggcgtcggcccacggccgtgggaccgtccctaggacgtacctccgtacctggtcgcgacgtccggtcgtaggtactttacccgaaccttcgaaggttactcgtaagttcgggacctagtcggtacccgtaaccgggtccgggggttaccccgacccggtaaccgggtcccgtaacccgggtaacggggaccgggtaaaaacggggggttccggttacgggggtacggggttacgggggggtttaacggtaacccgttttaaggggttttaaacggttaaacggggtttgggtttaaacgggttacgggtttaaaacgggtaagggggttaaaaaccgtttaaacgggtttaaccttaaaaaacgttttacgggttaacggtttaccggaaaccgttaaacccggtttaaccccggggttacccgggggttaaacccggggtaaaacccggggtttaaccccgtttaacccggtttaacccccggtttaacccccgggttcccctaaaacccgggtaaaaccggggtaaccgttaaaacccgtaaaccccgttaaaaccccggaaaacggtaaaccccgtaccggtttaaaccgttacgggtaacccttcgtaaaccgggtaaagaaacccggttaccggaaaccgtaccgggtaaccgtaacgggaccggaaaccggggaccgaacggtaacgtaccgggttaacttacgttaggttacttcggtacgacgggtaacgaggtaaacggaccgaaacctccggtactaaccgggg

SEQ ID NO: 265480 - DNA, 754 bp, Homo sapiens
  misc_feature: GYAE6OF01CW12M.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctgagtcgttgggttttcctcgttgtcttcgttttaagaggtgtcctagtgtcaggtgcagcgtgggtggacggtcggtggggggacgcggtcggccccgaggtcccgtacggggaccgttccccgtaggacgtaccttccgtccgtgtacgcgtagcgttccgtaggtacttcctaaccttcgaagtacgtcagtcggacagtgtaccgtaccggttccgggtacccaccggacggtccctaccggaggggacggtaacgggggtccgttaggggacgggttcggggtcggtacgtaagtttaggtagttaggtaagtggtaacgttagggtaagtacgttaacaaagttaattacgtagaaccgaggtaccgtaccgggtaggaacccggtacgttacgtacccgtaccgtacctacgaaggacaaccaaccgtaacccaaggaccaacgtgtactactacgtacgaactaacgtaccgaaccgacgtaccgtagggacggaccggtaacggtaacccggacgtaccggtacgtttaacggtagtttaacggttgtacgggtgtaaacggagtaacggaacgaaccgccggttaaccccgaacggg

SEQ ID NO: 265481 - DNA, 748 bp, Homo sapiens
  misc_feature: GYAE6OF01ERL76.34.26.C04.1.454.CMB.1.raw
  modified_base (194)..(194): a, c, t, g, unknown or other
  misc_feature (194)..(194): n is a, c, g, or t
  modified_base (737)..(737): a, c, t, g, unknown or other
  misc_feature (737)..(737): n is a, c, g, or t
  modified_base (739)..(739): a, c, t, g, unknown or other
  misc_feature (739)..(739): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcacagtggtaggtttgggctggacgtcgtttcgggttttcctggttcgtactttactttttaaaggnggttcgtccaggttcgtcgtagggtgacaggtcgttgggtagggtacggtcgggtaggggggaccgtcggttccgggacccaggtcccggttagggggtaccccttccgtggaaccgtccttccgttccgttgtcgacgtgtccgttcgtagtactttccacctttgaagttatctagtcggctagtcgacgtaccggttcgggacccgtcgaggtcccgtcgaagggccggtaaggggtcgttaaggggtcgggtgggtaccggtaactagggtttactagggtttagtattagggaggttaaggtaaacgttcgtaacaaatttaccgaggttcaccggtaacggtccgttacggggacggtaacgggtcctacgttaccgtaccccggtacttaccggaagtacgtaaacccgaacttaccgaaacgaccttacgacgtttaccgtattaccgtacgaacgtaagtacccgacgtacgttacgacgacggtaccgacgggtacaccgtcggtattgtaagtctgacgtgacgtagacgancncgcgtacgg

SEQ ID NO: 265482 - DNA, 769 bp, Homo sapiens
  misc_feature: GYAE6OF01ASJ3G.34.26.C04.1.454.CMB.1.raw
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (217)..(217): a, c, t, g, unknown or other
  misc_feature (217)..(217): n is a, c, g, or t
  modified_base (746)..(746): a, c, t, g, unknown or other
  misc_feature (746)..(746): n is a, c, g, or t
tcagtacacgtgatcacgaccggtgctcgatttagtctagcgactttgggtttgggcgtgggagaggagcccagcactagaggtcggcggtgtttccattcggtgatcagcactgaacacagaggactcaccagtggagtttgggctgagtcttgggttttcctcgttgcttacgttttaagngtgtcctagtgtacgtaggtncgagcgtggtggnggtcgtggggcgtccgtaggccccgagtccggtcgggtaccgtcccgtggaaccgtctttccgtccgttggtacgtccgtcggtccttcgtacggttcttaccgtccgttacgaaggttcgttaccagtcggtactacgttcgaccgttccggtaccgggttcccgaccgtacggtcccgtaacggacgggtacggaaacggggtcgtgggaacggttcgggcgtacgtgtaaagttggtagttcgtagaggtagtaacgtaagacttaacgtattaagcgtacgtaagttcccgtacggtagggaccggtaacgttccgttacgaacccgtttcgaacgtaacggacttaacccggtaaactaccccggaaaagtaaccgtcgtaacgttgtaactcgtaaccgtaacgtaacgtaccgtaaccggacgttacacggtaagacccggtaacggaccgtagttaaacccgtagtaccgttacgtttaaaggttccgcggttaacgtaggaaaccgtacggttaaaaccncccggtaagtacccggtaacggg

SEQ ID NO: 265483 - DNA, 819 bp, Homo sapiens
  misc_feature: GYAE6OF01AYJD6.34.26.C04.1.454.CMB.1.raw
tcagtacacgtgatcacgaccggtgctcgatttagtctagcgactttgggtttggggctgggagaggagcccagcactagaggtcggcgtgtttccattcggtgatcagcactagaacacagacggactcaccagtggtagttgggctagagtcgttcggtttttacctgttgcctttacgtttaaagcggttagtccgtagttcgtacgaggttcgctaggtcgtgggtcggtaggttcgggtagggggaccggtcgtccggacccgtaggcccggttaggtaccgtcccgtagacgtaccttcgtcctaggtcgacgtcgtacgtcgttacgttacttacctaccttcgtaaggtacgtccgagtcgattaagtcgcgtaccggtcgggtacccaccggcgtaccggaccggtagggacgggtaacggggacgtggggtacggttacggggtcgtaacgtttaagtagtacgttaggtacgtaggtacgtagtaacgtaacgtactaaaacgttcgtagtacgacgtaccgtttaaccggcgggttaacggtacccggtcggttaacctttcccgtaaccccggttacgtaaccgaacgaacccgtaaacctaacccggtaaaaccgtaacccggtaaaccgttaccgtaacgtttacaaccggtttaccaaacccgttaaccgaacggtaaacccggtacccaacgggtacgaacgggtaaccggacccggtaaggaccgaacccgggttattccgttaagttacggttaacttaacggtcgaagtacgaacgacgaacgcgtaaacgcgttaacg

SEQ ID NO: 265484 - DNA, 659 bp, Homo sapiens
  misc_feature: GYAE6OF01A7T9P.34.26.C04.1.454.CMB.1.raw
  modified_base (179)..(179): a, c, t, g, unknown or other
  misc_feature (179)..(179): n is a, c, g, or t
  modified_base (275)..(275): a, c, t, g, unknown or other
  misc_feature (275)..(275): n is a, c, g, or t
  modified_base (373)..(373): a, c, t, g, unknown or other
  misc_feature (373)..(373): n is a, c, g, or t
  modified_base (447)..(447): a, c, t, g, unknown or other
  misc_feature (447)..(447): n is a, c, g, or t
tcagtacacgtgatcacgaccggtgctcgatttagtctagcgactttgggtttgggctgggagaggagcccagcactagaggtcggcggtgtttccagttcggtgatcagcactgaacacagaggactcaccatggagtttgggctgagtctgggttttcctcgttgcttattttaagnggtgtccagtgtcgaggtgctaggcgttggtggacgtcgtggggggacgtcgtcggcccaggccgtgggaccttcccgtgacgtctcctcgtggtnccgtagcgttcgtggtactttccgacctttgagttacgtcagtggcagtcgcacggttcgggaccccgcgacggtcctaccgagggacgtaggggtcnggggtaggttggggtcgtactaggtttagtagttggttacgtggtagtacgggtaaagttactaacgaattacngtacgacagtaccgtcggtacggacgtcgtacttaccgtacccgtaccgtacgaagtaacgacctaacgtaccgaaacgaccgtacgtacttacgtactctaacgtaaccgtagaccgtaccgacgtacgtagacggcgaccgggtacgaaccgtgtacgttgtacgttagtcgtaggtcgaacggtacggagaccgacgagtcccgtacgg

SEQ ID NO: 265485 - DNA, 801 bp, Homo sapiens
  misc_feature: GYAE6OF01C1I3H.34.26.C04.1.454.CMB.1.raw
tcagtacacgtgatcacgaccggtgctcgatttagtctagcgactttgggtttgggctgggagaggagcccagcactagaggtcggcggtgtttcattcggtgatcagcactgaacacagaggactcaccagtggagtttggctcgagtcgttcgggttttcctcgtttacgtcgtttacgttttaaaggaggttcgtacccgtaggttcgtacgagggttcgcgtacggtcgttgggttagggacggttcggtagggggggacggtccggttacgggaccccagggtcccggtacggggtaacccttccccgtagaaaccgtcccttccttaccgtggaccggcgtaacggtccgttcgttaaggttaccttacccgttacccttagtaacggttaacgtacgtaacgttcggaactcggttacggaccgtaaccgggtcggggttacccccgacgtaccgggaccctaccgggaacggggacgggtaaccggggcttaggggtacgggtcggggtcgacttaaaggttacgttaggtagggtaaatccgggaaaggtttaggaaacgtttaacggactaaattaggtgtagacgtacgtaccgtacggtacgaccggtactacctacgtacccgtacaacgaacgtaccaacacgaaccctaagactacgacttacgtactacgacgaactaacgactaccgtacgacgtaagacggtacgacggtacgaccgtacggtaactggttaacctaggtacgtagacggtacgtaaacgacgaagacgtaccgacggtaccg

SEQ ID NO: 265486 - DNA, 727 bp, Homo sapiens
  misc_feature: GYAE6OF01C7B9T.34.26.C04.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (180)..(180): a, c, t, g, unknown or other
  misc_feature (180)..(180): n is a, c, g, or t
  modified_base (373)..(373): a, c, t, g, unknown or other
  misc_feature (373)..(373): n is a, c, g, or t
  modified_base (716)..(716): a, c, t, g, unknown or other
  misc_feature (716)..(716): n is a, c, g, or t
tcagtacacgtgatcacgaccggtgctcgatttagtctagcgactttgggtttgggcgtgggagaggagcccagcactagaggtcggcggtgtttccattcggtgatcagcactgaacacagaggactcaccatggagtttgggctgagctggttttccncgttgcttctttaagnggtntccagtgtcaggtgcagctgggtgacgttcgagggggagcgtggccccaaggtccgttcggggaacctcccgtaggacgtaccttcgtccttaggtgccgtaaggtccgttcgtaagggtactttacctaaccgtttcaacggttagtaccaagtcgggacctaagttcggaccgtaccgtcggggttacccncgtagggtccctaccgaagggtaccgaaaggggtcttagggaggtaggggtcggactaaggtttagaacgtggttaaagtgtaagttacggtaaaatcgtaacaactttacgaagtcgtaaccgaaacgttcccgtacggtaacggaacggtaccgttacgttaccacccgtaacgtacccgaagaaccggtaactaaccgtaacccgaaagtaacccgtacgtacgtactacctacgtacgaacctaaagtccgaacgtacgtcgtacgacggtaacggaccggaacggacgtacgtacgttagtacgttaagttcgtacgtagacgaagtaacggagaacncgtccgtaacg

SEQ ID NO: 265487 - DNA, 863 bp, Homo sapiens
  misc_feature: GYAE6OF01B950M.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatgggtagtttgggctggagtcgttggggttttcctcgttgcttcgttttaaagaggtgtccaggtgtcgagggtcgcagtcgttgggtaggtaggttcggtagggggggacgggtccggtcgggaccccgaggtcccggtaggggtaccgtcccgtaggaacgtaccgttccttcccggtggtcgccgtaggtccggttcgtaggtaactttcccaacctttcaggttacgtacgaagtcgggacatcggaccgtaccgggttccggggttaccgccgacgggtcccgtaccgggaacggacgggtaacggggtcgtaggggtacgggttggggtcgtacgtagttagtagtggtagtaggtagtacgggtaagtaagtaactaacgttatagtcgaccgtaacgggtacgtttacccgggaaggggtaccgggttacccgaacggtttacccgtaaccccggttaccgttaaccgggaacgtaaaccgtacccgtaaaccggttaaaccccgaaaacggaaacccttccggttaaccgttacggttaaccttacgggaacgtaaacctaaacgggttacccgaaccgtacggtaacctaagggaacccgccgggtaaacgggtaccgtacggtaacgggtaacgtacgttaaggttaaagggtttccgtttacgtaggggtacctaagggtaaccgggtaaggtaacccgcgggtaaaccggtaacccg

SEQ ID NO: 265488 - DNA, 986 bp, Homo sapiens
  misc_feature: GYAE6OF01BLQAG.34.26.C04.1.454.CMB.1.raw
  modified_base (108)..(108): a, c, t, g, unknown or other
  misc_feature (108)..(108): n is a, c, g, or t
  modified_base (880)..(880): a, c, t, g, unknown or other
  misc_feature (880)..(880): n is a, c, g, or t
tcagtacacgtgatcacgaccggtgctcgatttagtctagcgacttttgggtttggggctgggagaggacgcccagcactagaggtcggcggttgtttccattcggtnatcagcactgaacacagaggactcaccagtggtagtttggctgacgtcgttcgggttttcctcgtttgtccttacgttttaaaggaggttcgtccgtaggtgtacagggttgccgtagtcgtgggtggtaggtcgggttaggggggacgtccggtccgggtacccgaaggtcccggttacgggggtaccccgttccggtagaaccggtcctccgttcccgtggtaccggacctaacgggtccgtttacgtacgggttaaccctttcccgttaaccccgttagaaacgggtttacgacgtaaacgttcgggactaaaccgttcggaacccgttacccgggtttccggggcccgtaaccggttaccgggaccgttaacccgggaacgggtaccggggttaaaacggggtcgttaaccgggggttagggttcgggacccggttaagttaaggtttaggtagtttaagggtacgttaacggtaaggttaaacgggtaaaacgttacgtaactttaaaacgttaccggtaacggttacggaaaccgtaacccgggttaccgttaacgggaccggggtaaaccgtttaaccctaccgggtttaccccgaccccgttttaagaacccggtaaacggaaacccgacccgtaaacccggtaacccgtaaacgggtaaaccccgttcgttacgttaaacccggttctaacgggttaaaccaaaccgttaaccggtacgtaaaccccgtacggttaacggaccgggaacgggttaaaccccgnggtaaaaccgggtctaaacggttcgttaaaacgtttcccggttaagtcgggacttagggtaaacccgaacgtaaccggaacgtacccttaggcccgggtttaacgg

SEQ ID NO: 265489 - DNA, 854 bp, Homo sapiens
  misc_feature: GYAE6OF01E3AHO.34.26.C04.1.454.CMB.1.raw
  modified_base (749)..(749): a, c, t, g, unknown or other
  misc_feature (749)..(749): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggtactcaaccatggtagtttgggctgagtcgttggttttctcgttgcttctttaaggagtgtcagtgtctaggtgacacgtcgtgggtcgaggtcggtagggggacgcgtcggcccgacggtcccgtgggacctcccgtgacgtaccttcctacgtgcgaccggtagtcgtacgtcggtaacttccctaacctttcgacggttacgtcgacgtcggtagtaccgttcggaccgtacggtccgggttaccccggaccggtaacgggtcccgtacccggaacgggaaccggtaagggggttccgtaaggggtacgggttcggggttacgggaaccttagggtttaagttacggttagggttaacttagggttaaaccggttacgggggtaaatttaaaccggtactttaaaaaccgtttagtaaacggttcggtaaacccgttaaacgggtaaccccggtttaccggggtaaagggtaaaccccggggttaccgttaaccctttccccgtaaacccgttccgaaccggtaacgaaaacggttaccccaaacgttaacccccggaaaagtacccgacggtaccttacggtacctacgtaaccgaaactaacggacccgaacgttaccgngtaaccggacggtacccggaaccgtcgaaaaccggtccgtaagttcgtacgttacgttacgaaggttccgaaacgtacgaacgttaacgccgaacgctaaacggg

SEQ ID NO: 265490 - DNA, 665 bp, Homo sapiens
  misc_feature: GYAE6OF01C6WF5.34.26.C04.1.454.CMB.1.raw
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
  modified_base (409)..(409): a, c, t, g, unknown or other
  misc_feature (409)..(409): n is a, c, g, or t
  modified_base (553)..(553): a, c, t, g, unknown or other
  misc_feature (553)..(553): n is a, c, g, or t
  modified_base (654)..(654): a, c, t, g, unknown or other
  misc_feature (654)..(654): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggaggtttgggctgagtcgttgggtttttcctcggtttgtcctttacgttttaaaggagggttctccgaggttgtcgaggtgcagcgtgggtggagtccggtagggggacgtcggtcggacccgaggtcccgtaggggacccgttccccgtggaacgtccttccgtccgtaggtcgacgngtccgttctggacttcaccttgagtcgnagtgccatcggcacggttcgggccactcggcctcggagacgggaagggtcgtgggaggttcgggagngttaagttacgtaggtaggttagtagaacggtttaggtaaacgtagtaacctagtactagtcgacgacgtccgtacgtacggacgtaccgtataccgaccgtcgacaagacgaactaacgaccaacgaactcgtactctacgtnaacgaatacgaccgtcgaacgtccgtaaggacacgggccgtaaaggcccgaagtaccgtacggttacttagttcgacggtcgagtaacggacgagtaccgngtccgtaccgg

SEQ ID NO: 265491 - DNA, 813 bp, Homo sapiens
  misc_feature: GYAE6OF01BR53I.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagagacctcaccagtggagtttggctgagcgttggttttcctgttgcttacgttttaaggaggtgtccaggtgtcgaggtcgactagcgtgggtggaggttcgggtggggggacgtcggttaccggcccgtacggtcccggttacggggacccgtacccgttaggaacccgtccgttccctccgttggttacgaccgtacggtccgttacgtacgggttaacctttcccgtaacccgttagtaaccggtttacgtaccgtaaggtcggtacctaaggttcgaccgtaaccggttccgggtacccgaccggtacggtcgtacccggaagggtcccggtaaggggtccgtaggggtacggtcggggtgtaacgttagttagtcggttacggttagtggtagttaacggaaggttacgtaactaaagtacgttagacggaactacggtaaccgttcggtacggtaacggtccgtaccgttaacccgtcccgtaccgtaaccgaagtaaccgacgtaaaccgtacccgtaacgaacgtaccgtcgttaacgtctaccgtaagtaacgtaacgtaccgtaccgtagtaccgacgtacggacggtaccggtaccgtacgaaccggttacgtacgttacgttacggttacgtcgggttacgaccggaagtacccgaacgtacccgaccgtccgtaaccgg

SEQ ID NO: 265492 - DNA, 666 bp, Homo sapiens
  misc_feature: GYAE6OF01BUFBR.34.26.C04.1.454.CMB.1.raw
  modified_base (92)..(92): a, c, t, g, unknown or other
  misc_feature (92)..(92): n is a, c, g, or t
  modified_base (159)..(159): a, c, t, g, unknown or other
  misc_feature (159)..(159): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
tcagtacacgtgatcacgaccggtgctcgatttagtctagcgactttgggtttggggctgggagaggagcccagcactagaggtcggcggtntttccattcggtgatcagcactgaacacagagactcaccatggagtttggctgagtcgtggtttccncgtgcttacgtttaagngtntccagtgtcaggtncgtagcgtggnggcgtggtggggacncgtccggccctaggcccgtacgggaccttcccaggactaccttcctaccgtggtacaccggtgtcttacggacgttacttaccctaccgttagaacgttactacgagtcgactagtcgacgtaccggtccggtccgccgagtccacggtaggccggtagggtccgtaggcggttgacgtcttaaggttgtaagtcgtaggtagtaacggtacggtactaaggtacctaaaggttacgtataccggaccgtacggtacccgtaggtaccggacggtaccgtacgtaccgtaccctcgaacgtagaaccgttacgaacgtaccaacgtactacgtacctagtaccgagtacaacgtaacgtcgaacgccgtagacgacgtcgaacggtacgactcgtattcggtagtacgtcgtgtacccgagtaccgataccgctaacgccgtaacgg

SEQ ID NO: 265493 - DNA, 709 bp, Homo sapiens
  misc_feature: GYAE6OF01DJP8O.34.26.C04.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (386)..(386): a, c, t, g, unknown or other
  misc_feature (386)..(386): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcacatggagtttggctgagtcttgggttttcctcgttgcttacgttttaaggaggtgtccagtgtcaggtncagcgtggtggagtcggtggggggacncgtggaccccaggtcccgtaggggaccctccctaggaacgtccttcctcgtgtcgctacggtcgttcgtggtaccttaccgtaacctttacgaagttacgtcctaagttcggctaacgtggaccgttaaccggtcgggggttccccacggtacgggtaccnccggaagggtaccggaaggggtccgtaaggggtggtgggtcgacgtaaagttcgtaaggtgtacgtgaaggtaggaaagttacgtataacgtactagtcgaagacgtaccgtcggtaaggtaccgggtaccgtatccgacctcctacgaaagtaccgaactacaacccgaaagacctacggacttcggtactacgacgaacgtaacacgaccgtagaccgtaagggaccgaacggtaccggtacggaacggtaagtcgtaaaccgttggttaaaccttcggcgtacggaacgtaggtaacggctaacccgtcgacgtaaccgg

SEQ ID NO: 265494 - DNA, 495 bp, Homo sapiens
  misc_feature: GYAE6OF02HIBZY.34.26.C04.1.454.CMB.1.raw
  modified_base (303)..(303): a, c, t, g, unknown or other
  misc_feature (303)..(303): n is a, c, g, or t
  modified_base (428)..(428): a, c, t, g, unknown or other
  misc_feature (428)..(428): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccaggcctgggacgtccctgagactctcctgtgcagcgtctggattcaccttcagtagtcatggcatgcactgggtccnccaggctccaggcaagggctggagtgggtggcagttatatggtatgatggaagtagtcaagtactatgacagactcgtgaagggcgatcacgtctcagagacaatcccaagaacacgctgtatcngacaaatcgaaccagcctgacgagccgagacacggctatgtatactgtgcgagagagacacgctacg

SEQ ID NO: 265495 - DNA, 490 bp, Homo sapiens
  misc_feature: GYAE6OF02IQQG3.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcactgggtccgccaggctccaggcaaggggctggagtgggtgcagttatatggtatgatggaagtagtcaatactatgcagactccgtgaagggcattcaccgtctcagagacaatcccaagaacacgctgtatctagacaatcgaccagcctgacgagccgagacacggctatgtattactgtgcgagagagacagcacg

SEQ ID NO: 265496 - DNA, 508 bp, Homo sapiens
  misc_feature: GYAE6OF02IAFX8.34.26.C04.1.454.CMB.1.raw
  modified_base (343)..(343): a, c, t, g, unknown or other
  misc_feature (343)..(343): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctgggagtggggtggcaggttanagtggtatgatggaagtagtcaaatactatacagactccgtagaagggccattcacgtctccagagacaatcccaaagaaccacgctgtatctgacaaatcgaaccagcctagacgagccgaggacacggctagtgtattacgtgtgcgagagagacagccatcg

SEQ ID NO: 265497 - DNA, 512 bp, Homo sapiens
  misc_feature: GYAE6OF02I9V0A.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtctgggggaggcgtggcccagcctgggacgtccctgagactctcctgtgcagcgtctggattcaccttcagtagtcatggcatgcactgggtccnccaggctccaggcaaggggctgggagtggggtgctagttatagtggtatgatggaagtagtacaatactatgcagactcgtgaggcgatcacgtctcagagacaatcccaagacacgctgtactctagacaatcgaaccagtcctagacgacgaccgagaccgacggtactaagtgtaacttacgtgtgacgtagagagacaggacctacg

SEQ ID NO: 265498 - DNA, 573 bp, Homo sapiens
  misc_feature: GYAE6OF02H1S00.34.26.C04.1.454.CMB.1.raw
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggtcggttcgcgtaggctctttaagtaggtgtcagtgtcagtgcagcgtggtggagtctgggtgaggcgtggcccagcctgggcgtccctgagctctcctgtgcagcgtctggattcacttcagtcgtcatggcatgcatgggtccnccaggtcnccgagctaaggggctggagtggtgcagttanagtgtatgacgtggaagtntnaacgtatatgcaagctccgtagaacggtccgaattcgacgttccgtaccgaggaacgacaaagtacccccaaagggaaccctacggaccttaggtacttccgttacgaaccaaaacgttcggaacccgtaagtcccgttaggaacgacgaccgtacgggaactacgggcttacgtagtacttacgtaggtcgaacggtgaaggagacctagtaccc

SEQ ID NO: 265499 - DNA, 495 bp, Homo sapiens
  misc_feature: GYAE6OF02IITF4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccgccaggctccaggcaaggggctggagtgggtgcagttatatggtatgatggaagtagtcaatactatgcagactccgtgaagggccgattcaccgtctccagagacaatcccaagaacacgctgtatctgacaatgaaccagcctgagagccgaggacacggctatgtattactgtgcgagagagacagccacg

SEQ ID NO: 265500 - DNA, 679 bp, Homo sapiens
  misc_feature: GYAE6OF02F4LQ2.34.26.C04.1.454.CMB.1.raw
  modified_base (191)..(191): a, c, t, g, unknown or other
  misc_feature (191)..(191): n is a, c, g, or t
  modified_base (650)..(650): a, c, t, g, unknown or other
  misc_feature (650)..(650): n is a, c, g, or t
tcagtacacgtgatcacgaccggtgctcgatttagtctagcgactttggtttggggcctgggacgaggagcccagcactagaggtcggccggtcgtttccatttcggtgagtcccaggcacgtggaaccacagagacctcaccatgggagtttcggctagagcggtgggttttcctgttgcttctttaagnggtcgtcagtgtctaggtgcagccctaggtcgagtcgtggggtaggcgtggacccagccgtcgggaccgtcccgtgacgacctcttcctgtgccacgcgtccggattccaccttcagtcgtccagtcggatatcgcgaccttcggggtacccgcctaagggccttaccgagggccgaaggggtcttagggtagtttcggggtgcctaaggtttactagtggtaatggtagttgggaacgttgtacgtaaagtttaccgtattcggtacctaggtaccttccggtacgggaacgggtaccgtacgttacccgtacccgttacgtacccgaaggaccgaaccgaacccgtaccccgaaagtaaccctacgtaccttacgttacttcccgtacgtacctaaacgtcgtaacctacgtcctagaacgacggaccgacggacgacggctagttagtacttacgngtacgcgagacgacgacgacgtcacgtcg

SEQ ID NO: 265501 - DNA, 519 bp, Homo sapiens
  misc_feature: GYAE6OF02J1P46.34.26.C04.1.454.CMB.1.raw
  modified_base (272)..(272): a, c, t, g, unknown or other
  misc_feature (272)..(272): n is a, c, g, or t
  modified_base (341)..(341): a, c, t, g, unknown or other
  misc_feature (341)..(341): n is a, c, g, or t
  modified_base (403)..(403): a, c, t, g, unknown or other
  misc_feature (403)..(403): n is a, c, g, or t
  modified_base (440)..(440): a, c, t, g, unknown or other
  misc_feature (440)..(440): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgcgtagcgtctttaagaggtgtccagtgtcaggtgcagctggtggagtctgggggagcgtggcccagcctgggacgtccctgagctctcctgtgcagcgtctggattcaccttnagtagtcatggcatgcacgtgggtccgccaggctccgaggctaaggggctgggagtgggtgcaggttanagtggtatgatggaaacgttgcaatctagtcgacagactccgtgaacgggcattcacgttcnccagagacactcccgaaagacacgtctagtactacgngacaaacgtcgaacctagcctagacgacgccgagtacacggtctatgtattacgtgtcgacgagagagacagcctacgg

SEQ ID NO: 265502 - DNA, 543 bp, Homo sapiens
  misc_feature: GYAE6OF02INMPW.34.26.C04.1.454.CMB.1.raw
  modified_base (338)..(338): a, c, t, g, unknown or other
  misc_feature (338)..(338): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggaccgtccctgagactctcctgtgcagcgtctggattcaccttcagtagtcatggcatgcacgtggggtccgccaggcctccgaggcaaggggctgggagtggggngcagttatagtggtatgatggaagtagtacaatactatgacagactccggtaggaacgggccgtattccgacccgttctaccgaaggaacgaaccaactacccaaagaaccacgctagtaactctagacaaatcgaaccagcctagacgacgccgaggaccacggctaagtgtattacgngtagcgagagacgacacgaccaacg

SEQ ID NO: 265503 - DNA, 651 bp, Homo sapiens
  misc_feature: GYAE6OF02HHK41.34.26.C04.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (185)..(185): a, c, t, g, unknown or other
  misc_feature (185)..(185): n is a, c, g, or t
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagtacacgtgatcacgaccggtgctcgatttagtctagcgacttgggttgggctgggagaggagcccagcactagaggtcgcgtgttccattcggtgatcagcactgaacacagaggactcaccatggagtttgggctgagctgggtttcccgttgctctttaagngtntccagtgtcaggtncagctggtgatctggggancgtggcccagcctgggactcctagacgactctccgtgtcgcagcgtctaggatttccgactttcagttgtccagtggctaagtgcacgtgggccncaggtctcgaggcaaggggctgggacgtggtacgctaggttactagtcggtaatcggattcggaacgttcgtaccaagttaccgtatggacctacggtactccggtagaacgggtcctagttccgaccggttcgtccgtaaggtaacgtacctaaacggttccccgtaaaggaccgtaccgtacgttcggtaaccgttccgtacggtaacctaaacgtcgaacccgtacgtcccgtaggtacgtaaccgaccggttaacggaccgtaaccggtccgtaacgttaccggaactttaccggacgtacgttaccggaagtaaccggtacggtaccgtaccggtaccgttaaccgg

SEQ ID NO: 265504 - DNA, 497 bp, Homo sapiens
  misc_feature: GYAE6OF02F4BO7.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccnccaggctccaggcaaggggctgggagtggggtggcagttatatggtatgatggaagtgtcaatactatgcagactccgtgaagggccgattcaccgtctccagagacaatcccaagaacacgctgtatctgacaaatgaaccagcctgagagccgaggacacggctatgtattactgtgcgagagagacagccacg

SEQ ID NO: 265505 - DNA, 555 bp, Homo sapiens
  misc_feature: GYAE6OF02GP7GW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttccgtcgtagctctttaagaggtgtccagtgtcaggtgcagctggtggagtcgtgggggagcgtggcccagccgtgggacgtccctgagactctcctgtgcagcgtctggacttcaccttcagtagtcatggcatgcacgtgggtcccgcaggctccgaggcgaggggctggagtggggtgctagttatagtggtatgatggaagtagtcaatctatgacagactcgtagacgggcatcaccgtctccagacgacaactaccaagaaccacgctgtactactgacaaacgtcgaaccacgtaccgtagacggacgaccggacggaccgaccggtagttaacgttagttaacgttacgtaggtacggacgaaggagtaacgaccgtaacggccctaacgg

SEQ ID NO: 265506 - DNA, 506 bp, Homo sapiens
  misc_feature: GYAE6OF02F5P0D.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccgaggcaaggggctgggagtggggtgcagttatagtggtatgatggaagtagtacaatactatgcagactcgtagaggccgattcaccgtctccagacgacaactcccaagaaccacgctgtatctgacaaatcgaccagcctagagacgccgaggacacggctaagtgtattacgtgtgcgagagagacagccacg

SEQ ID NO: 265507 - DNA, 505 bp, Homo sapiens
  misc_feature: GYAE6OF02I6B8H.34.26.C04.1.454.CMB.1.raw
  modified_base (338)..(338): a, c, t, g, unknown or other
  misc_feature (338)..(338): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcactgggtccgcaggctccaggcaagggctgggagtggggtgcagttanagtggtatgatggaatagtcaatactatgcagactcgtagaggcatcacgtcacagagacaactacccaagaaccacgctagtactcgtagacaagtcgaccagcctagacgacgaccgagacacggactagtacgtacttactgtagcgagagagacagcctaacg

SEQ ID NO: 265508 - DNA, 526 bp, Homo sapiens
  misc_feature: GYAE6OF02F7EIN.34.26.C04.1.454.CMB.1.raw
  modified_base (304)..(304): a, c, t, g, unknown or other
  misc_feature (304)..(304): n is a, c, g, or t
  modified_base (491)..(491): a, c, t, g, unknown or other
  misc_feature (491)..(491): n is a, c, g, or t
  modified_base (504)..(504): a, c, t, g, unknown or other
  misc_feature (504)..(504): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcacttcagtagtcatggcatgcacgtggggtccnccaggcctccgaggcaaggggctgggagtggggtgctagttatagtggtatggagtggaagttagtcaaatactatgcagacctccgtagaacgggccgtattccgaccgtctaccgaagacgaccaactacccaaagaacacgctagtactctgacaatcgaccagcctgagagccgagacacggntagtgtacttcgngtgacgagagagacagcctacg

SEQ ID NO: 265509 - DNA, 542 bp, Homo sapiens
  misc_feature: GYAE6OF02HQTIU.34.26.C04.1.454.CMB.1.raw
  modified_base (261)..(261): a, c, t, g, unknown or other
  misc_feature (261)..(261): n is a, c, g, or t
  modified_base (274)..(274): a, c, t, g, unknown or other
  misc_feature (274)..(274): n is a, c, g, or t
  modified_base (368)..(368): a, c, t, g, unknown or other
  misc_feature (368)..(368): n is a, c, g, or t
  modified_base (417)..(417): a, c, t, g, unknown or other
  misc_feature (417)..(417): n is a, c, g, or t
  modified_base (440)..(440): a, c, t, g, unknown or other
  misc_feature (440)..(440): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttcgtcgttagctctttaagaggtgtcagtgtcaggtgcagctggtggagtctgggggaggcgtggcccagcctgggactccctgagactctcctgtgcagcgtntggattcaccttnagtagtcatggcatgcacgtgggtcccgccaggctccgaggcgaaggggctggaggtggggtgctagttaatgtggtatgataggaagtagtanaatactagtgacagtactcgtagacgggcctattcgacgtctacgaganacaatcccaaagaacctcgactntactctagacaagtcgaccagtcctaggagagtaccggaaggacgtacggtattacggtgtttaactcgtagtgacggaggaagagaacgtacgctaaccgg

SEQ ID NO: 265510 - DNA, 520 bp, Homo sapiens
  misc_feature: GYAE6OF02IHLI4.34.26.C04.1.454.CMB.1.raw
  modified_base (343)..(343): a, c, t, g, unknown or other
  misc_feature (343)..(343): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactggggtccgccaggctccaggcaaggggctgggagtggggtgcagttanagtggtatgatggaagtagtcaatactatgcagactcgtgaggccgatcaccgtctcgagacgacaactcccaaagaaccacgctagtactctgaccaaagtcgaaccacgaccctgacggacgaccgaaggaccacggctaagtgtaattcgtgtgcggagagagaactgaccacg

SEQ ID NO: 265511 - DNA, 503 bp, Homo sapiens
  misc_feature: GYAE6OF02HAMK4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccaggcctgggacgtccctgagactctcctgtgcagcgtctggattcaccttcagtagtcatggcatgcactgggtccgccaggctccaggcaaggggctgggagtggggtggcagttatagtggtatgatggaagtagtcaatactatgcagactcgtgaagggccgatcaccgtctccagagacaatacccaagaacacgctgtatctgacaaatgaaccagcctgagagccgagacacggactatgtattacgtgtgacgagagagacacgccacg

SEQ ID NO: 265512 - DNA, 706 bp, Homo sapiens
  misc_feature: GYAE6OF02J1ZBP.34.26.C04.1.454.CMB.1.raw
  modified_base (159)..(159): a, c, t, g, unknown or other
  misc_feature (159)..(159): n is a, c, g, or t
  modified_base (191)..(191): a, c, t, g, unknown or other
  misc_feature (191)..(191): n is a, c, g, or t
  modified_base (274)..(274): a, c, t, g, unknown or other
  misc_feature (274)..(274): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcncgttgctctttaagaggtgtcagtgtcaggtncagctggtggagtcgtgggggagcgtggcccagcctgggacctccctgacgactctcctgtgcagcgtctggacttcaccttnagtagtcagtcggctatcggctacgttcgggtccacctaggcctaccgagggtccgaagggggtctaggggacgttggggtagactaaggtttatacgtgggtaactggaacgttagggtaaacttacgtaccaaaatttaccgtaagtcgggaacctaagggtaacccgtttacccgggaggtaaaccggggtccctaacgtttacccgaacccgggttactaaccgaaaggaaccgtaaacctaaccgttaaccccgaaaaggtaaccaccggttacgttacggttaactcgtaacggaacctaaaagtccgaacctacgcccgtaaggaacggaccggaccggaaggtacctacgggtacttaacgttaggttaaccttaacgtcggtacggaaccggaagtaacggacgaacccgtgacccgtaacgg

SEQ ID NO: 265513 - DNA, 494 bp, Homo sapiens
  misc_feature: GYAE6OF02GKJ21.34.26.C04.1.454.CMB.1.raw
  modified_base (301)..(301): a, c, t, g, unknown or other
  misc_feature (301)..(301): n is a, c, g, or t
  modified_base (473)..(473): a, c, t, g, unknown or other
  misc_feature (473)..(473): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccnccaggctccagggcaaggggctggagtggggtggcaggttatagtggtatgatggaagtagtcaatactatgcagactcgtgaggcattcacgtctccagagacaatcccaagaacacgctgtatctagacaatgaccagcctgagagccgaggacaggctatgtattacgngtgcgagagagacagcctacg

SEQ ID NO: 265514 - DNA, 511 bp, Homo sapiens
  misc_feature: GYAE6OF02F2NFD.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtggggtccgccaggcctccgaggcaaggggctgggagtggggtgcagttatagtggtatgatggaagtagtacaatactatgcagactcgtagaagggcgattcaccgtctccagacgacaatcccaagaacacgctgtatctagacaaatcgaccagcctagagacgaccgaggacacggctagtgtattacgtgtgacgagagagacacgccacg

SEQ ID NO: 265515 - DNA, 510 bp, Homo sapiens
  misc_feature: GYAE6OF02I1EPA.34.26.C04.1.454.CMB.1.raw
  modified_base (346)..(346): a, c, t, g, unknown or other
  misc_feature (346)..(346): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccaggcctccgagggcaaggggctgggagtggggtggcagttanagtggtatgatggaagtagtcaatactatgcagactcgtgaagggccatcaccgtctccagagacaactcccaagaaccacgctagtactctagacaaatcgaccagcctgacgacgccgaggacacggctagtgtattacgtgtgcgagagagacagcctacg

SEQ ID NO: 265516 - DNA, 511 bp, Homo sapiens
  misc_feature: GYAE6OF02IIA3I.34.26.C04.1.454.CMB.1.raw
  modified_base (385)..(385): a, c, t, g, unknown or other
  misc_feature (385)..(385): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (487)..(487): a, c, t, g, unknown or other
  misc_feature (487)..(487): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtccgccaggcctccgaggcgaaggggctgggagtggggtgctagttatagtggtatggatggaagtagtcaatactatgcagctcgngaacggccatcacgtcncaganacaatccaagaacacgctgtactctagacaaatcgaaccagcctagacgacgccgaggacacggactagtagtattacgngtagacgagagagacacgcctacg

SEQ ID NO: 265517 - DNA, 564 bp, Homo sapiens
  misc_feature: GYAE6OF02H1VDY.34.26.C04.1.454.CMB.1.raw
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtggggtccgccaggctccgagggcaaggggctgggagtggggtggcagttanagtggtatggatggaagtagtcaatactatgcagactccgtagaacgggccgtattccaccgtctaccgagacgacaactcccgaaagaaccacgtctagtactcgtagacaaatcgaaccagcctaggacgacgaccgaaggaccacggtactagttacgttaacttacgtaggtacggacgaaggtaacggaacggaccgacggcccgtaaccg

SEQ ID NO: 265518 - DNA, 616 bp, Homo sapiens
  misc_feature: GYAE6OF02GG33F.34.26.C04.1.454.CMB.1.raw
  modified_base (354)..(354): a, c, t, g, unknown or other
  misc_feature (354)..(354): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcacgtgggtcccgccgaggcctccgagggcgaaagggggctgggaggtggggtgcagttanagtggtatgatgggaagtagtacaattactatgaccaaggtacctccggtaggaacggggtccgtaagtttcccgacccgttcctacccgaaggtaacgaaccaaacgttaccccaaaggaaaccaccgactagtactcgtagaacctaaacgtacgaacccgagtacccgtagaacgaacgaccggaacggaccgaccggtacttaagtacgttaacttaccgtggtacgacgaggaacggacgtacgacgcccgtaaccg

SEQ ID NO: 265519 - DNA, 518 bp, Homo sapiens
  misc_feature: GYAE6OF02JCXB9.34.26.C04.1.454.CMB.1.raw
  modified_base (445)..(445): a, c, t, g, unknown or other
  misc_feature (445)..(445): n is a, c, g, or t
  modified_base (483)..(483): a, c, t, g, unknown or other
  misc_feature (483)..(483): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtggggtcccgccagggcctccgaggcaaggggctgggagtggggtgcagttatagtgggtatgagtggaagtagtacaatactatgcagactccgtaggaacgggcattcaccgttctccagagacaatacccaagaacacgctgtactcngacaaatcgaaccagcctagagacgccgaggacacggntagtagtattacgtgtgcgagagagacagcctacg

SEQ ID NO: 265520 - DNA, 520 bp, Homo sapiens
  misc_feature: GYAE6OF02G0JQE.34.26.C04.1.454.CMB.1.raw
  modified_base (476)..(476): a, c, t, g, unknown or other
  misc_feature (476)..(476): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccgccaggctccaggcaaggggctgggagtggggtggcagttatatggtatgatgggaagtagtacaatactatgcagtactccgtagaacgggccgattcgaccgtctaccagacgacaactcccaaagaacacgctagtatctagacaatcgaccagcctgagacgccgaggacncggactagtgttatactggtagacgagagagacgtagcctaacg

SEQ ID NO: 265521 - DNA, 553 bp, Homo sapiens
  misc_feature: GYAE6OF02IEO5X.34.26.C04.1.454.CMB.1.raw
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcactgggtccncaggctccaggcaagtgggctggagtgggtgctagttatatggtatgagtggaagtagtcaatactatgcagactccggtgaacgggccgtattccgaccgtctaccagacgacaactcccaaagaaccacgctagtatctagacctaaagtcgaaccagcctaggaacgacggacccggaggacccgacgggtacttaagtaggtaactttaccgtggtcgacggaaggacggaacgaccgacgtacccg

SEQ ID NO: 265522 - DNA, 581 bp, Homo sapiens
  misc_feature: GYAE6OF02J29FW.34.26.C04.1.454.CMB.1.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (399)..(399): a, c, t, g, unknown or other
  misc_feature (399)..(399): n is a, c, g, or t
  modified_base (515)..(515): a, c, t, g, unknown or other
  misc_feature (515)..(515): n is a, c, g, or t
  modified_base (564)..(564): a, c, t, g, unknown or other
  misc_feature (564)..(564): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggtttcctcgttgctctttaagnggtgtccagtgtcaggtgcagcgtggtggacgtcgtgggggagccgtggcccagcccgtggggacctccctgacgactctccgtgnccagcgtcnggacttcaccttcagtagtcatggcctatcggaccncgtcgggtccgccncggctcccgagggccaagtgggctggaggtgggtggcagttgtatcgggaatgagtcggaaagtgtaccaatctagtncgacgacgttccggaggaacgggtcctaacgtcaacccgtctaccagagaccaaacttaccccgaaagtaaccacgtctgtaactcgtacgacaatcggacctagcctagacgacnccgttacggcttaaccggcttagagttaccttacgttggcgaccggaanagaccgtacgagacccg

SEQ ID NO: 265523 - DNA, 522 bp, Homo sapiens
  misc_feature: GYAE6OF02H2K4H.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgcaggctccaggcaaggggctggagtggggtgcagttatagtggtatgatggaagtagtcaatactatgacagactcgtagaggccgattcacgtctccagacacaactccaagacacgctagtactcagacaaatcgaaccagcctagacgacgccgaagacgacggtactagtagttacttaacgtgtacgacggtaggacgtaggaacacgcctaacgg

SEQ ID NO: 265524 - DNA, 499 bp, Homo sapiens
  misc_feature: GYAE6OF02IAXT7.34.26.C04.1.454.CMB.1.raw
  modified_base (363)..(363): a, c, t, g, unknown or other
  misc_feature (363)..(363): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccgccaggctccaggcaaggggctgggagtggggtggcagttatatggtatgatggaagtagtnaatactatgcagactcgtgaagggccgattcaccgtctccagacgacaactcccaagacacgctgtatcagacaatgaccagcctgagcgacgaggacacggctagtgtattactgtgcgagagagacacgctacg

SEQ ID NO: 265525 - DNA, 568 bp, Homo sapiens
  misc_feature: GYAE6OF02IZGWQ.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagctgggttttcctcattgctcttttaagnggtgtccagtgtcaggtgcagctggtggagtcgtgggggagcgtggcccagcctgggacctcctgagactctcctgtgcagcgtctggattcaccttcagtagtcagtggcatgctacgtgggtccgcaggcctccgaggccgaagggggctgggaggtggggtggcgtagtttagtagttgggtatggagtagggaaagttagtacaattactatcgcagacgtccggtaggaacgggtccattccgaccgtctaccgaagacgacctaacgtcccaaagaaccacgctagtactcgtagactaaagtcgaaccagtcctagacgacgaccgaggaccacggcttagtgttaacttacgtgtacgacgagacggacgtacgacgtaccg

SEQ ID NO: 265526 - DNA, 525 bp, Homo sapiens
  misc_feature: GYAE6OF02JIAIX.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccgaggcaaggggctgggagtggggtgcagttatagtggtatgagtggaaagtgtcaagtactatgcagacctcgtgaagggccgatcaccgtctccagagacaactcccaaagaacacgctagtatctagacaaagtcgaaccacgcctagagacgaccgaggaccacggactaagtagttattacgtcgtgacgagaaggagacgacgacctacg

SEQ ID NO: 265527 - DNA, 529 bp, Homo sapiens
  misc_feature: GYAE6OF02JH3TW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactggggtcccgccaggcctccagggcaaggggctgggagtggggtgcagttatagtggtatgatggaagtagtacaatactatgcagactccgtagaagggcgatcaccgtctaccagacgacaactacccaagaacacgctagtactctgacaaagtcgaaccagcctaggacgacgaccgaggaccgacgggctaagtagtacttacgtgtacgacgagacgagacacgcctacg

SEQ ID NO: 265528 - DNA, 513 bp, Homo sapiens
  misc_feature: GYAE6OF02JBD4T.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtggggtggcagttatatggtatgatggaagtagtcaatactatgcagactcgtagaagggcgtatcgaccgtctccagacgacaactccaagaacacgctgtatctagacaaagtcgaaccagacctgagacgccgaggacacggcttaagtagttagtactgtgacgagagagacgagccgtaacg

SEQ ID NO: 265529 - DNA, 602 bp, Homo sapiens
  misc_feature: GYAE6OF02JECJV.34.26.C04.1.454.CMB.1.raw
  modified_base (232)..(232): a, c, t, g, unknown or other
  misc_feature (232)..(232): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
tcagtacacgtgatcacgaccggtgctcgatttagtctagcgactttgggtttgggggtcgtgggaggaggaggcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggcccngcctgggactccctgagactctctgtgcagcgtctggactcaccttcagtatcatggcatgcactgggtccnccaggctccgagggcaaggggtctgggaggtggggtggcagtttanacgtggtaatgagtgggaattacgtacaattactatgcagtacctacggtagaacgggctaagttccaaccgtctccgtaaggaacaccgtaactccccaaaggaaccctaacggtcttacgtaacgtccgtagacctaaagttcgaaccgagtacccgtaggaaaccgacggaccggaacggttaccgaccgggacctaagttaccggttattaacctggtaccggagaggacgagaccgtacgcctaacg

SEQ ID NO: 265530 - DNA, 563 bp, Homo sapiens
  misc_feature: GYAE6OF02HOK7H.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtcccgccgaggcctccgaggcaaggggctgggagtggggtggcagttatatggtatgattagggaagtagtcaaagttactatgacaagtaccgtcggtaggaacgggccgtaattcccgaccgttcctacccgaggaacgaacaaacgttacccgaaagaaccacgactagtaatctagacaaagtcgaaccagcctagacgacggccgaggaccgacggtctaagtgttacttacgtgtgacgagacgaagacagacctacg

SEQ ID NO: 265531 - DNA, 510 bp, Homo sapiens
  misc_feature: GYAE6OF02H6HYF.34.26.C04.1.454.CMB.1.raw
  modified_base (490)..(490): a, c, t, g, unknown or other
  misc_feature (490)..(490): n is a, c, g, or t
tcagtacacgtgatcacgaccggtgctcgatttagtctagcgactttgggtttggagctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccgaggcaagggggctgggagtggggtggcagttatatggtatgatggaagtgtcaatactatgcagactccgtgaagggccattcaccgtctccagagacatacccaaagaaccacgctagtatcgtagacaaatcgaaccagccctagagagccgaggaccacggctagtgtacttacgngtgacgagagagaccagccc

SEQ ID NO: 265532 - DNA, 499 bp, Homo sapiens
  misc_feature: GYAE6OF02HB2T5.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtggggtggcagttatatggtatgatggaagtagtacaatactatgcagactccgtgaggcgattcaccgtctccagacgacaatacccaagaacacgctgtatctgacaaatcgaccagcctgagagccgaggacacggctagtgtattacgtgtgcgagagagacagccacg

SEQ ID NO: 265533 - DNA, 547 bp, Homo sapiens
  misc_feature: GYAE6OF02G4XEP.34.26.C04.1.454.CMB.1.raw
  modified_base (300)..(300): a, c, t, g, unknown or other
  misc_feature (300)..(300): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactcctgagactctcctgtgcagcgtctggattcaccttcagtagtcatggcatgcactgggtccnccaggcctccgaggcaaggggctgggagtggggtgcaggttatagtggtatggatggaagtagtcaatactatgcagactccgagaacggcgatcaccgtctaccagacacaactacccaagaaccacgctgtatctagacaaagtcgaaccagcctaggacgagacccgaggaccgacggtaccttaagtacgttaattaccgtaggtacgacggtaaggacggacggaaccacggaccctaaccg

SEQ ID NO: 265534 - DNA, 497 bp, Homo sapiens
  misc_feature: GYAE6OF02JDP8U.34.26.C04.1.454.CMB.1.raw
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtggggtgcagttatatggtatgatggaagtagtcaatactatgcagactcgtagaaggcgatcaccgtctccagacgacaactcccaagaacacgctgtatcngacaaatgaccagcctgacgagaccgaggacacggctagtntattcngtcgcgagagagacacgcacg

SEQ ID NO: 265535 - DNA, 539 bp, Homo sapiens
  misc_feature: GYAE6OF02HNGRX.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggcggagtcgtgggggaggcgtggcccagccgtgggacgtccctgagactctcctgtgcagcgtctggattcaccttcagtagtcatggcatgcacgtgggtccgcaggctccaggcaaggggctggagtgggtgcagttatatggtatgatgggaatagtcaagtactagtgcagactccgtaggaacgggcgtatcacgtctccagacgacaactacccaaagacaacgctagtactctacgactaaatcgaacctagacctgacgagaccgaaggacacgggactagtgttaacttacgtaggtggacgtaggacgacgaacgtacggaccctacg

SEQ ID NO: 265536 - DNA, 600 bp, Homo sapiens
  misc_feature: GYAE6OF02I1B9Q.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggaccgtccctgacgactctcctgtgcagcgtctggattcaccttcagtagtcatggcatgcacgtcggggtcccgccgaggcctccgaggcgaaggggctgggaggtggggtgcagtttatagtggtatgagtagggaagttagtacaaattactagtgcaagtaccgtccggtaggaacgggccgtaactttccgacccgttctaccgaaggaacgaaccaaactacccaaagaaccacgacttagtactctagaccaaatcgaaccagccctagacgacgaccggaaggaccgacggtacttaagtacggttaactttaccgtggtacgacggaggaacgaacgaccgacggaccctaacgg

SEQ ID NO: 265537 - DNA, 534 bp, Homo sapiens
  misc_feature: GYAE6OF02HIHB9.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagacctctcctgtgcagcgtctggattcaccttcagtagtcatggcatgcacgtgggtccgccaggcctccaggcaaggggctgggagtggggtggctagttatagtggtatggatggaagtagtacaatactatgcagactccgtgaagggccgatcaccgtctccagagacaactcccaaagaacacgctagtactctagacaaatcgaaccagccctaggaacgacgaccggacggaccgacggactaagtgttacttacgtgtgacgagagacggacacgcctaacg

SEQ ID NO: 265538 - DNA, 514 bp, Homo sapiens
  misc_feature: GYAE6OF02F68VT.34.26.C04.1.454.CMB.1.raw
  modified_base (302)..(302): a, c, t, g, unknown or other
  misc_feature (302)..(302): n is a, c, g, or t
  modified_base (426)..(426): a, c, t, g, unknown or other
  misc_feature (426)..(426): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtccnccaggctccgaggcaaggggctgggagtggggtgctagttatagtggtatgagtggaagtagtcaatctatgcagactcgtgacggcgattcaccgtctcagacgacaatcccaagaacacgtntgtactctagactaaactcgaccagcctagacgacgccgagacgacggactagtcgtagttacgtgtgacgagacgagacagcctacg

SEQ ID NO: 265539 - DNA, 554 bp, Homo sapiens
  misc_feature: GYAE6OF02GY08U.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggctccaggcaaggggctgggagtggggtggcagttatagtgggtatgagtggaagtagtacaaatactaatgacagtactccggtaggaacgggccgtaattccgacccgttcctaccgaagtaacgaccaaactcccaaagaaccacgctagtaactctagacaaagtcgaaccagcctagacgacgaccgaggaccgacggactaagtagtactacgtgtagacgtagagacgacacgcctaacg

SEQ ID NO: 265540 - DNA, 558 bp, Homo sapiens
  misc_feature: GYAE6OF02H39C5.34.26.C04.1.454.CMB.1.raw
  modified_base (382)..(382): a, c, t, g, unknown or other
  misc_feature (382)..(382): n is a, c, g, or t
  modified_base (413)..(413): a, c, t, g, unknown or other
  misc_feature (413)..(413): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccctgggaccgtccctgacgactctcctgtgcagcgtctggattcaccttcagtagtcatggcatgcacgtcggggtccgccagggctccgagggcaaggggctgggagtggggtgcagttatagtggtatggatggaagtagtcaatactangctagacgtcgtgaaggccgtatcgacgtcnccagacgacaactacccaagaacacgctagtactcgtagacaaatcgaaccacgccgtaggacgacggccggaacggacgtaacggcgttaagttacgttaacttacgttggtcgacggaaggaggaacggaccacgaccctacg

SEQ ID NO: 265541 - DNA, 527 bp, Homo sapiens
  misc_feature: GYAE6OF02H1G5Q.34.26.C04.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtctgggggagcgtggcccagccctgggactccctgagactctcctgtgcagcgtctggattcaccttcagtagtcatggcatgcactgggtccnccaggctccaggcaaggggctggagtggggtggcagttanagtggtatgatggaagtagtcaaattactatgacagactcgtagaacggccgtaattccgaccgtctaccaagacgaaccaagtcccaaagaacaccgtatgtatctagaccaaatcgaccagcctagagacgaccgaggaccacggactatgtactacgtgtagcgaaggagagacacggactacg

SEQ ID NO: 265542 - DNA, 518 bp, Homo sapiens
  misc_feature: GYAE6OF02F1B9S.34.26.C04.1.454.CMB.1.raw
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtggggtcccnccgaggcctccgaggccaagggggctgggagtggggtgcagttatatggtatgagtggaagtagtacaatactatgcagactcgtagagggcgattcaccgtctaccagacgacaactaccaagaacacgctatacnctgacaatacgaccagtcctagacgagaccgagacgacggcgtatacgtattacgtgtagcgagagagacacgccacg

SEQ ID NO: 265543 - DNA, 611 bp, Homo sapiens
  misc_feature: GYAE6OF02GHXT1.34.26.C04.1.454.CMB.1.raw
tcagtacacgtgatcacgaccggtgctcgatttagtctagcgactttgggtttggggctggggagacggagcccagcaactagaggtcggtcggtgtttccattcggtgatcagcaactgaacacagaggacctcaccattgggagtttgggctgaggtcctggggtttttcctcgtttgtactcgtttttaagaggtgtccagtgtcaggtgcagctggtgggagtcgtgggggagcgtggcccagcctgggactccctgagactctcctgtgcagcgtctggattcaccttcagtagtcagtcggccagtcgcacgtcgggtacccgccagggcctccgagggtcgaagggggctgggacgtggggtcgactaggttatagtgggtaatggaataggaagtagtactaaatacgtatcggaccaacggtacctccgtaggaacgggcccgtaattacccgacccgtactacccgaagacgaacaaacttcccaaagaaccacgtctagtactcgtagaccaaagtcgacctacgcctagacgacgaccgaggacgacggtactaagtacgtatacgtgtcgacgacgagtacgactacgtccgtaccgg

SEQ ID NO: 265544 - DNA, 642 bp, Homo sapiens
  misc_feature: GYAE6OF02GJHBV.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtcccgccgaggcctccgaggcgaaggggctgggagtggggtgcagttatagtgggtatgagtggaagttagtacaatactatgacaagacgttccgtaggaacgggccgtatttaccgaccgttctacccgaaggaacgaaccgaaacttacccaaaggaaacccacgtaccgttagtacttcgtaggaacctaaagtccgtaacctacggtaccgtaggtaacggaaccggacccggtaacgggaccgtaaccggtaccgttaaacgttacggtttaacgtttaccgttaggtaccgggacggtaacgggtaacggaacggtaaccgacggtaccctaacccgg

SEQ ID NO: 265545 - DNA, 537 bp, Homo sapiens
  misc_feature: GYAE6OF02INTOT.34.26.C04.1.454.CMB.1.raw
  modified_base (504)..(504): a, c, t, g, unknown or other
  misc_feature (504)..(504): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtggggtccgcccagggcctccgagggcaaaggggctgggaggtggggtggcagttatatggtatgatgggaagtagtacaaatactagtgacagtacctaccggtgaacgggccattaccaccgtctccaagaacgacaactacccaaagaaccacgctagtatctgacaaatcgaccagcctagagacgaccgagacacggtactagtntattactggtagcggagagagacgacgaccacg

SEQ ID NO: 265546 - DNA, 553 bp, Homo sapiens
  misc_feature: GYAE6OF02HEBD0.34.26.C04.1.454.CMB.1.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgcgtagctctttaagaggtgtccagtgtcaggtgcagctggtggagtcgtgggggagcgtggcccaggcctgggactcctgagctctcctgtgcagcgtctggattcaccttnagtagtcagtggcatgcactgggtccnccaggctccgaggccaaggggctgggagtggggtgcaggttatatgggtatgagttggaaagtcgtacaattactatggacagtactccgtagaacgggcctaagttcgaccgtctaccgagagaacatacccgaagaacacgctagtactctagaccaaatcgaccagacctggaaacgcgaccggagacgtacggtactaagtacggttattaacgtggttacgacgaacggagaacgacgtacgccctaagg

SEQ ID NO: 265547 - DNA, 526 bp, Homo sapiens
  misc_feature: GYAE6OF02GXTS4.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtccnccaggcctccgaggcaaggggctgggagtggggtgctagttatagtggtatggatggaagtagtacaatactatgcagctcgagaagggcctattcaccgtctaccgagacgacaactacccaagaacacgctagtatctagacaaatcgaaccagcctagacgacgccgaggacacggcttaatgttattacgtggtcgacgagagagacacgccctacg

SEQ ID NO: 265548 - DNA, 511 bp, Homo sapiens
  misc_feature: GYAE6OF02HAJ48.34.26.C04.1.454.CMB.1.raw
  modified_base (491)..(491): a, c, t, g, unknown or other
  misc_feature (491)..(491): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccaggcctccgaggcaagggggctgggagtggggtggcagttatagtggtatgatggaagtagtacaatactatgcagactccgtagaacgggccattccaccgtctccagacgacaactcccaagaccacgctgtactctagacaagtcgaccagcctagagagccgaggacacggctatgtatacgngtgcgagagagacagccacg

SEQ ID NO: 265549 - DNA, 645 bp, Homo sapiens
  misc_feature: GYAE6OF02I6GDG.34.26.C04.1.454.CMB.1.raw
  modified_base (256)..(256): a, c, t, g, unknown or other
  misc_feature (256)..(256): n is a, c, g, or t
  modified_base (372)..(372): a, c, t, g, unknown or other
  misc_feature (372)..(372): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctctttttaagaggtgtccagtgtcaggtgcagctggtggagtctgggggagcgtggcccagcctgggactccctgagactctcctgtncagcgtctggattccaccttcgagtagtccagtgggcagttgccacgtcggggtcccgccagggcctcccaggggccaaagggggcttggggaggttgggggtagctaggtttaangttcgggtaattggaacgttgggaaggttagtaccaaattacgtatcggctaagggaaccgttccggtaggaaacggggtcccgtaagtttcccgaaccggttcctaccgaacggaagaaccctaaactaccccgaaacggaaaccacgtacttaggtactcacgtaccaaacgtccgaccctaggacccttaggagaccggaccgaacgggaccacggtactaacgttgttaacttacgtggtagacggacggagacggacctagccctacg

SEQ ID NO: 265550 - DNA, 513 bp, Homo sapiens
  misc_feature: GYAE6OF02G9O5L.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctgggagtggggtgcagttatagtggtatgatggaagtgtcaatactatgcagactcgtgagggccatcaccgtctccagagacaactcccaagaacacgctgtactctgacaatcgaaccagcctaggacgagtacgaggacacggtactagtagtaagttacgtggtagacgagacgagacacgacctacg

SEQ ID NO: 265551 - DNA, 560 bp, Homo sapiens
  misc_feature: GYAE6OF02HG5AC.34.26.C04.1.454.CMB.1.raw
tcagtacacgtgatcacgaccggtgctcgatttagtctagcgactttggggtttggggctgggagaggagcccagccacgtagaggtcggcggtgtttccattcggtgatcagcactgaacacgagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtggggtcccgccaggcctccgagggcgaagggggctgggaggtggggtggctaggttatagtgggtatgagtgggaagtagtacaaattactatgacagtactccggtggaacgggccgtatccgacccgttctaccgagacgaacaactacccgaaagaaccgacgactagtactctagacaatcgaccacgcctagacgacgccgaggaccgacggtctagtgttaacttacgtgtagacgtagagagacacgccacg

SEQ ID NO: 265552 - DNA, 529 bp, Homo sapiens
  misc_feature: GYAE6OF02I4U4B.34.26.C04.1.454.CMB.1.raw
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggattccaccttcagtagtcatggcatgcacgtgggtccnccaggctccgaggcaaggggctgggagtggggngcagttatatggtatgagtggaatgtacaatactagtgcagacctccgtaggaacggccgtattcaccgtctccagacgacaactccaagacacgctagtancganacaatcgacagcctagacgacgacgaggaccacggacttagtacgttattacgtggtacgacggtagagacgacgtacgcctacg

SEQ ID NO: 265553 - DNA, 534 bp, Homo sapiens
  misc_feature: GYAE6OF02FSPVM.34.26.C04.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggaccgtccctgagactctcctgtgcagcgtctggattcaccttcagtagtcatggcatgcacgtgggtccnccaggcctccgaggcgaaggggctgggaggtggggtgcagttanagtggtatgatgggaagtagtacaatactatgacagactcgtagacgggcgattcaccgtctaccagacgacaactacccaagaacacgctgtatctgacaagtgacacgccgtagacgaggacgggacacggcgtggtgtacttcgtgtcggtcggttcttttacggtccttacgtagtcgcctag

SEQ ID NO: 265554 - DNA, 611 bp, Homo sapiens
  misc_feature: GYAE6OF02H6BFK.34.26.C04.1.454.CMB.1.raw
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
  modified_base (583)..(583): a, c, t, g, unknown or other
  misc_feature (583)..(583): n is a, c, g, or t
tcagtacacgtgatcacgaccggtgctcgatttagtctagcgactttgggtttggggtcgtgggagaggagcccagcacctagaggtcggcggtgtttccacttcggtgatcagcacttgaacacagaggactcaccatggagtttgggctggagctgggttttcctcgttgctcttttaagaggtgtccagtcgtcaggtgcagctgggtggagtctgggggagcgtggcccaggccctgggactcctaggagactctcctagtcgctaggcgtctggattcaacctttcagtagtcatggctatgctacgtgggtccncaggcctccgagggccgaaggggctagggacgtggggnggctaggtttanagttggtatggagtgggaaagttagtctaaattacctatcggacaacggtcctaccggtagggaacgggtccgtaacttcccgaaccgttctaccgaaaggagtaaactaacttacccaaagtaaccacgtcttagaacttcgtagaactaagtcgaccgacgccgtagacgacggaccgaaggacgacggtactagtacgtaactacgttgngcggtagacgacgacaccggacctacgg

SEQ ID NO: 265555 - DNA, 506 bp, Homo sapiens
  misc_feature: GYAE6OF02F9R94.34.26.C04.1.454.CMB.1.raw
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggctccaggcaaggggctggagtgggtgcagttanagtggtatgatggaagtagtacaatactatgcagactccgtagaacgggccgatcaccgtctccagagacaactacccaagacacgctagtactctgacaatcgaccagcctagacgacgcgaggacacggctatgtatacgtgtgacgagagagacacgcctacg

SEQ ID NO: 265556 - DNA, 827 bp, Homo sapiens
  misc_feature: GYAE6OF02FENVJ.34.26.C04.1.454.CMB.1.raw
  modified_base (167)..(167): a, c, t, g, unknown or other
  misc_feature (167)..(167): n is a, c, g, or t
  modified_base (185)..(185): a, c, t, g, unknown or other
  misc_feature (185)..(185): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggaggtttgggctgagtcgtttgggttttccngttgcttacgtttaaggnggttgtccaggttgtcgaggtgacgaggtcggtgggtggaggtcgggtgggggacgtccggtcggccccgtaggtccgtacgggtacccgttcccgtaggaccgtcttccgttccgtggtcgaccgtaggtccgttcgtacggttacctttccgtaaccgttgtaaggtacgtcagttcggactacggttccggaccgttaccgggtccggtacccggaccggtaccggtaccgaccggggaaggggtaccgggtaacgggggtcggttaagggggtcgggtttacgggggtagtacggtttaaaggtttaggtagggttaggtaattaaggggtaaggtaacgggttaacgttaacggtaacttaaacggttcgtacgtaccggaccgtaacggtaccgggtacggtaacggaccgtttacctaccgtttaacccggaccgttaccgaacgaacgaaacctaccgttaaaccgaaccgaacgttaaccttcgacgttactaccgtaacggtaaccaaacttaacggacccgtaacgccggtaagaccgaacgggtacgaccgtaaccgtctagttaacgtttaaggcgtttaaacggcggaagtaggaacctcgaaacgtcccacgttacgacggtaccgg

SEQ ID NO: 265557 - DNA, 532 bp, Homo sapiens
  misc_feature: GYAE6OF02FR351.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtggggtcccnccaggcctccgaggcgaaggggctgggagtggggtgctagttatagtggtatggatggaagttagtacaaatactatgcaagactccggtagaacgggccattccaccgtctaccagacacaactacccaagaaccacgctagtatctgacaaatcgaccagcctagacgacgccgaggacgacggctagtagttactacgtgtcgacgagagagacacgcctacg

SEQ ID NO: 265558 - DNA, 533 bp, Homo sapiens
  misc_feature: GYAE6OF02JI2EJ.34.26.C04.1.454.CMB.1.raw
  modified_base (262)..(262): a, c, t, g, unknown or other
  misc_feature (262)..(262): n is a, c, g, or t
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtntggattcaccttcagtagtcatggcatgcacgtgggtccgccaggctccaggcaaggggctggagtgggtgcagttanatggtatgatggaagtgtcaatctatgcagactcgngaggccatcacgtctacgagacgacaatccaagaacacgctagtatctgacaaatcgaaccagccgtagacgagccgaaggaccaacgggtctaagtcggttaagttaccgtggttacggaccgtaaggacggtaaggacctacggaccctaaccgg

SEQ ID NO: 265559 - DNA, 543 bp, Homo sapiens
  misc_feature: GYAE6OF02G5B3R.34.26.C04.1.454.CMB.1.raw
  modified_base (249)..(249): a, c, t, g, unknown or other
  misc_feature (249)..(249): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
  modified_base (515)..(515): a, c, t, g, unknown or other
  misc_feature (515)..(515): n is a, c, g, or t
tcagtacacgtgatcacgaccggtgctcgatttagtctagcgactttgggtttggggtcgtgggaggaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtctgggggagcgtggcccagcctgggactccctgagctcncctgtgcagcgtccggattcaccttcagtagtcatggcatgcactgggtccgccaggctccgaggctaaggggctggaggtgggtggcagttagatgggtatggatgggaagtcggtacaatactagtgaccaggactccgtagaagggcccgaagtttccaccggtctacccgagtacgacaactacccaaagaaccacgctagtatcgtnaccgaaatcggacctagcctagacganccgaggactacggatacgtgtattacngtgacgaggacgagactagccactacgg

SEQ ID NO: 265560 - DNA, 505 bp, Homo sapiens
  misc_feature: GYAE6OF02GAS3N.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggactccctgagactctcctgtgcagcgtctggattcaccttcagtagtcatggcatgcactgggtccnccaggctccaggcaaggggctggagtgggtggcagttatatggtatgatggaagtgtacaatactatgcagactcgtagaggccgattcacgtctccagacgacaatccaagaacacgctagtatctagacaaatcgaccagcctagagacgcgaggacacggtactagtgtattacgtagtgacgagagagacgacgcctacg

SEQ ID NO: 265561 - DNA, 492 bp, Homo sapiens
  misc_feature: GYAE6OF02HD844.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggctccaggcaaggggctggagtgggtgcagttatagtggtatgatggaagtagtcaatactatgcagactcgtgaggcgatcacgtctcagagacaatcccaagaaccacgctgtactctagacaatgaccagcctgagagccgaggacacggctatgtatacgtgtagcgagagagacagcctacg

SEQ ID NO: 265562 - DNA, 684 bp, Homo sapiens
  misc_feature: GYAE6OF02HZU5K.34.26.C04.1.454.CMB.1.raw
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggccctgggaccgtccctgacgacctctcctgtgcaggcgtctggattccacctttnagttagtcatggcatgcacgtggggtcccncaggcctccgagggccaaggggctagggagtggggtgctagtttanagttggtatggagtagggaaagttacgtacaaattactagtcgactacgtaccgtaccggtaggaacgggtcctaacgtttccgaaccgttcctaccgaaggtacgaaactaaaccgtaccccgaaagaaacccgaccggtacgttacgtaacttcgtaacggaacctaaaagtcgaacccgagtacccgtaggaaacggtacggaccggacgggtaaccgtaccgggtacttaacgttacggttaaacgtttccggttagggttacggaacggggtaacggtaaacggtaaccggaaaccgtaccggttaacccctaaccggg

SEQ ID NO: 265563 - DNA, 501 bp, Homo sapiens
  misc_feature: GYAE6OF02HBWUM.34.26.C04.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccnccaggctccgaggcaaggggctgggagtggggtggcagttanatggtatgatggaagtagtcaatactatgcagactcgtgaacgggccgattcaccgtcncagagacaatcccaagaacacgctgtatctgacaaatgaccagcctgagagccgaggacacggctatgtacttacgtgtgcgagagagacagcctacg

SEQ ID NO: 265564 - DNA, 602 bp, Homo sapiens
  misc_feature: GYAE6OF02J2R2Z.34.26.C04.1.454.CMB.1.raw
  modified_base (159)..(159): a, c, t, g, unknown or other
  misc_feature (159)..(159): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
  modified_base (517)..(517): a, c, t, g, unknown or other
  misc_feature (517)..(517): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcncgttagctctttaagaggtgtccagtgtcaggtgcagctggtgagtcgtgggggagcgtggcccagccgtggggacctccctggacgctcctccgtggtcgccaggccgttctggatttccacctttcaagttgtcatggctatcgcncgtcggtcccgcaggcctaccgaggccgaaggggctgggagttggggagctaggttangtggtatgagtggaatgtacaattacgtancggacaacggtaccgtaccggtaggaacgggtcctacgttaccgaccgtcgtaccgagaacgtaacaacgtacccaaaggaacctacgtacgtagtacttcgtataccgaacgtcgaaccgngttaccagacgacgcgacggaccacgtcgtaacgtgttacgtaccgtggtacggacgaggaaccgagtaccgacgtccctaacgg

SEQ ID NO: 265565 - DNA, 565 bp, Homo sapiens
  misc_feature: GYAE6OF02HJ0A6.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggattcaccttcagtagtcatggcatgcacgtgggtcccnccaggcctccgaggccgaaggggctgggacgtggggtgctagttatagtggtatgataggaatagtacaaattactatcgacaagtaccgtccggtaggaacgggccgtaattccgaccgttctaccgaagacgaacaacgtacccaaagaacacgactagtactctagacaaatcgaaccagcctaggacgacgaccgaggaccgacggtactaagtgttattacgtgtaggacgtaggagacgaacgacgaccctacg

SEQ ID NO: 265566 - DNA, 532 bp, Homo sapiens
  misc_feature: GYAE6OF02HO3XZ.34.26.C04.1.454.CMB.1.raw
  modified_base (510)..(510): a, c, t, g, unknown or other
  misc_feature (510)..(510): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcacgtgggtccgccgaggctccgaggcaaggggctgggagtggggtggcagttatagtggtatgatggaagtagtacaaatactagtgcagtacctcgtagaacgggccgtatccaccgtctaccgagaacgacaactacccaagaaccacgctagtatctagacaaacgtcgaaccgacgcctagagacgacgaggacgacggactaatgtattacgngtagcgagagagacagcctacg

SEQ ID NO: 265567 - DNA, 514 bp, Homo sapiens
  misc_feature: GYAE6OF02GLJ2R.34.26.C04.1.454.CMB.1.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccnccaggctccgaggcaaggggctggagtggggngcagttanagtggtatgatggaagttagtcaatactatgcagactcgtgaagggccgattccgaccgtctccgagacgacaactcccaagaaccacgctagtactctagacaaatcgaaccagcctagagagccgaggacacggctatgtattagtgtgacgaggagagacacgcctacg

SEQ ID NO: 265568 - DNA, 519 bp, Homo sapiens
  misc_feature: GYAE6OF02HB9KE.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggcctccatgcaaggggctgggagtgggtgcagttatatgggtatggatggaagtagtcaaatactatgcagactccgtagagggccgattcgaccgtctccagacacaactacccaaagaaccacgctgtatctagcaaatcgaaccagccctagacgacgaccgaggaccacgggtactagtgtaattacgtgtgacgagagacgacagaccc

SEQ ID NO: 265569 - DNA, 693 bp, Homo sapiens
  misc_feature: GYAE6OF02JW65N.34.26.C04.1.454.CMB.1.raw
  modified_base (178)..(178): a, c, t, g, unknown or other
  misc_feature (178)..(178): n is a, c, g, or t
  modified_base (195)..(195): a, c, t, g, unknown or other
  misc_feature (195)..(195): n is a, c, g, or t
  modified_base (434)..(434): a, c, t, g, unknown or other
  misc_feature (434)..(434): n is a, c, g, or t
tcagtacacgtgatcacgaccggtgctcgatttagtctagcgactttggtttggggtcgtgggagaggagcccagcactagaggtcggcggtgtttccattcggtgatcagcactgaacacagaggactcaccatggagtttgggctgagctgggttttcctcgttgctcttttaagnggtgtccatgtcaggtncagctggtggacgtcgtgggggaaggcgtggcccaagccgttggggaaccgttcccaggagtaccttcctccgtaggtgcccaaaggccgttcgtaggtacttccacccgttttcaaggttgtcgaagtcgggccattgcccgtaaaggttcgggtcccgccgaggcccttacccgagggcgtaaacgggggtctaggggaggttcggggtcgcgttaaaggttatacgttgggttaanggaccgttagggtaaccgtaagtccaaaaatcttaagcggacaacggtctaccgtacggaacgggtacccgtaacgttccgtaacccggttccgtaccgtacgacgaaccaacgttacccgaagaaacccgacgtaccgttagtacgtacctagttacgaaacgttacgacctacgtaaccgtggaacgacgaccgacgtacgcggtacctagtacctaggttacaggttacgacgagacggacgacgaccgacaaccg

SEQ ID NO: 265570 - DNA, 533 bp, Homo sapiens
  misc_feature: GYAE6OF02FZWS4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcacgtgggtccgccaggcctccgagggccaaggggctgggagtggggtgcagttatagtggtatggatggaagtagtcaatactatgcaagtactccgtagaacgggccgattcaccgtctaccagacgacaactacccaagaacaccgctagtactactacgacaatcgaccgacgcctagacgacgccgaggacacggactacgtagttacgttactgtgacgagagagacagccctacg

SEQ ID NO: 265571 - DNA, 513 bp, Homo sapiens
  misc_feature: GYAE6OF02FV1AU.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtgggtccgccaggcctccgaggcaaggggctgggagtggggtgcagttatagtggtatggatggaagtagtcaatactatgacagactcgtagaggcatcacgtctcagagacaatcccaagaacacgctagtactcagacaaatcgaaccagcctagacgacgaccgaggaccacggactaatagtaacttactgtgacgagagagacagcctacg

SEQ ID NO: 265572 - DNA, 548 bp, Homo sapiens
  misc_feature: GYAE6OF02IZ7O3.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgactctcctgtgcagcgtctggattcaccttcagtagtcatggcatgcacgtgggtccnccaggctcgaggcaaggggcctgggagtggggtgactagttatagtggtatggatggaagttgtacaatactagtgacaagtacgtccggtaggaacgggccgtagttccgaccgttcgtaccgaagacgaaccaaacgtacccaaagaccacgcttagtatcgtagacaaatcgaccagcctagacgacgcgagacaggtactagtagttacttacgtgtagacgagacgagacgacgcctacg

SEQ ID NO: 265573 - DNA, 533 bp, Homo sapiens
  misc_feature: GYAE6OF02J1TRU.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggaccgtccctgagactctcctgtgcagcgtctggacttcaccttcagtagtcatggcatgcacgtggtccncaggctccaggcaaggggctgggagtcgggtgcagttatagtggtatgagtggaaagtgtcaaatctatgcagactcgtgaggccgtatcaccgtctaccagtacgactaactacccgaaagaaccacgactgtaacttcgagtacaaagtcgaaccagcccgtgacgagacccgaggtaccacggactagtagtacttaacgtgtcgacgagagagactacgacctacg

SEQ ID NO: 265574 - DNA, 537 bp, Homo sapiens
  misc_feature: GYAE6OF02F8LCS.34.26.C04.1.454.CMB.1.raw
  modified_base (340)..(340): a, c, t, g, unknown or other
  misc_feature (340)..(340): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtcccgccaggcctccgaggcgaaggggctgggaggtggggngctaggttatagtggtatggagtggaagtagtacaatactatgcaagctcgtagaacggcctatcaccgtctacgagacgacaactacccaaagaacacgctgtactctagacaagtcgaaccgacgccgtagacgacgacgaacggacacggactaagtagtacttacgtgtgacgaggagaagaccagacctacg

SEQ ID NO: 265575 - DNA, 540 bp, Homo sapiens
  misc_feature: GYAE6OF02JG0A1.34.26.C04.1.454.CMB.1.raw
tcagtacacgtgatcacgaccggtgctcgatttagtctagcgactttgggtttgggggctgggagaggagcccagcactagagttcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtatcatggcatgcacgtgggtccgccaggcctccgaggcaaggggctgggagtggggtgctagtatagtggtatgagtaggaagtagtacaatacgtatgcaagtacctaccggtaggaacgggccgtacgttacgaccgtctaccgagtacgaaccactacccgaagaacacgctagtatcagacaatcgaccacgctagacgacgaccgaggacacggtactagtagtacttacgtgtgacgagagacgacacgactacg

SEQ ID NO: 265576 - DNA, 580 bp, Homo sapiens
  misc_feature: GYAE6OF02HVXBP.34.26.C04.1.454.CMB.1.raw
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (350)..(350): a, c, t, g, unknown or other
  misc_feature (350)..(350): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtggggtccnccaggcctccagggccaaggggctgggagtggggnggcaggtttanagttggtatgagtgggaagtagtcaaatactatgacagactcgtaggacgggccgtattccaccgtctccgagacgacaactacccgaaagaaccacgctgtactctagacctaaacgtcgaaccacgtcctaggaacggacgaccggaaggaccgacggtcgttaatacggtttaacttacgtaggttggaccgggaaggtacggaaggaccgtacggaccctaaccgg

SEQ ID NO: 265577 - DNA, 569 bp, Homo sapiens
  misc_feature: GYAE6OF02GLB2U.34.26.C04.1.454.CMB.1.raw
  modified_base (355)..(355): a, c, t, g, unknown or other
  misc_feature (355)..(355): n is a, c, g, or t
tcagtacacgtgatcacgaccggtgctcgatttagtctagcgactttgggtttggggcgtgggagaggaggcccagtacaactagaggtcggcggtgtttccattcggtgattcagcacctgaacacagaggactcaccatggagtttgggctggagcgtgggttttcctgttgcttcttttaagaggtgtccagtgtcaggtgcagctgggtggagtcgtgggggagcgtggcccagcctgggaccgtccctgagactctcctgtgcagcgtctggattcaccttcagtagtcatggcatgcacgtgggtccgccaggctccgaggcaaggggctgggagtggggtgcagttanagtggtatgatggaagtagtcaatactatgacagctcgtagaacgggccgtattccaccgtctaccgagacgacaatacccgaagaacacgctacggtatacgtgactaaagtcgaaccgtacgtcctgaacgacgacccggaggaccacgggtactaagttacgttaacttaccgtggtacgacggtaaggagacgacgtacgaccgtaaccg

SEQ ID NO: 265578 - DNA, 543 bp, Homo sapiens
  misc_feature: GYAE6OF02IWS2E.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagaggtgtccagtgtcaggtgcagctggtggagtcgtgggggagcgtggcccagccgtgggacgtccctgagactctccgtgtgcagcgtctggattcaccttcagtagtcatggcagtgcacgtgggtcccnccaggctccgaggcgaaggggctgggaggtgggtgctagtatagtggtatgagtggaagtagtacaattactatgacagtcgtccgtagaacgggccgtattccgaccgttctacgaagtacgaacaacgtacccgaaagaaccacgactgtaatctagacaagtcgaccacgcctagacgacgacgacgacgacgagtactgtactagtgtgacgacgagtagacgacgacctacg

SEQ ID NO: 265579 - DNA, 614 bp, Homo sapiens
  misc_feature: GYAE6OF02J2YA2.34.26.C04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagnggtgtccagtgtcaggtgcagctggtggagtctgggggagcgtggcccagcctgggacgtccctgagactctcctgtagcagcgtctggattccacttcagtagtcatggcatggcacgtggtcccncgaggcctccgagggcgaaggggcttagggaggttggggaggcctaaggttagtacgttgggtataggagttacggaagttacgtacaaattacgtaatggacaacgtaccgtaccggtaggaacgggtccgtattaccgaccggttacctaccgaagtaacgaacctaacgtacccaaagaacctacgcttagtacttcgagaccaaacgtcgaacccgagccgtagacgacgaccgaaggtaccacggtacgtaagttcgtaacttacgtggacgtacggaggacgacgaccgtacgacccgtaacgg

SEQ ID NO: 265580 - DNA, 532 bp, Homo sapiens
  misc_feature: GYAE6OF02I5WZH.34.26.C04.1.454.CMB.1.raw
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggaccgtccctgacgactctcctgtgcagcgtctggattcaccttcagtagtcatggcatgcacgtgggtccgccaggctccgagggcaagggggctgggaggttggggtgcaggttatagtggtatgagtggaagtagnaatctatgacagactccgtgaacggcgactcaccgtnaccgagacgacactaccaagaacacgctagtactcgtgacaatcgaaccagcctgacgagccgaggacgacggactagtacgtagttacgtggtacgacgaggacgagacgacgacctacg

SEQ ID NO: 265581 - DNA, 513 bp, Homo sapiens
  misc_feature: GYAE6OF02G6NMB.34.26.C04.1.454.CMB.1.raw
  modified_base (301)..(301): a, c, t, g, unknown or other
  misc_feature (301)..(301): n is a, c, g, or t
  modified_base (342)..(342): a, c, t, g, unknown or other
  misc_feature (342)..(342): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccnccaggctccaggcaaggggctgggagtggggtggcagttanatggtatgatggaacgtagtcaatactatggacagactccgtagagggccgattcacgtctcagagacaatcccaagaacacgctagtactctgactaatcgaccacgcctaggagagaccgaggacacggctaatcgtaatcgtgtgacgagtagacgtacaggcctacg

SEQ ID NO: 265582 - DNA, 582 bp, Homo sapiens
  misc_feature: GYAE6OF02GQWEG.34.26.C04.1.454.CMB.1.raw
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (360)..(360): a, c, t, g, unknown or other
  misc_feature (360)..(360): n is a, c, g, or t
tcagtacacgtgatcacgaccggtgctcgatttagtctagcgactttgggtttgggcgtgggagaggagcccagcactagaggtcggcggtgtttccattcggtcgatcagcactcgaaccacagaggactcaccatggagtttgggctgagctgggtttcctcgttgctcttttaagaggtgtccagtgtcaggtgcagctggtggagtcgtgggggaggcgtgggccccagccgtgggacgtccctgagactctcctgtgcagcgtctggattcacctttcagttagtcatggcatggcacgtcggggtcccnccgagggctccgagggcgaaggggctgggagtggggngcagttanagtggtatgagtggaaagtagtacaaatactatgacagtactccgtaggaacgggtccgaatttccgacccgttctaccgaagaacgactaacctacccgaaagaaccacgctagtactctagactaaagtcgaaccgacgccgtagacgacgacgagacgacggactaagttacgtaacttacgtcggttagacgaaggtagaacggactacgcctaacgg

SEQ ID NO: 265583 - DNA, 606 bp, Homo sapiens
  misc_feature: GYAE6OF02ICHKX.34.26.C04.1.454.CMB.1.raw
  modified_base (177)..(177): a, c, t, g, unknown or other
  misc_feature (177)..(177): n is a, c, g, or t
  modified_base (404)..(404): a, c, t, g, unknown or other
  misc_feature (404)..(404): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagcccgtggggacgtccctgacgactctcctgtgcagcgtctggattcaccttcagtagtcatggcatgcctacgtgggtcccgccgaggcctccgagggccgaagggggctagggaggtgggggtggctaggttaataggtggtatgagttagggaaagtagtacaaattacttagngacaggtacctaccggtaggaacggggcccgtaattaccgtacccgtctaccgagacgaacaactacccaaagaaccacgtctagtatctagactaatcgaccacgtacctaggaacgacggaccgaggtaccgacggtactaagtacgtaacttaccgttaggtcggacggaacggacggaacgaccgacgtaccctaacg

SEQ ID NO: 265584 - DNA, 599 bp, Homo sapiens
  misc_feature: GYAE6OF02H0AA6.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggactccctgacgctctcctgtgcagcgtctggattccacctttcagtagtcagtggcatgcacgtgggtccgccaggcctccgaggcgaaggggctgggaggtggggtggctagttatagtggtatggagtaggaagtagtacaattactagtgacacgtaccgtccggtaggaacgggtccgtatttccgaccgttcctaccgagaacgacaaaccgtacccaaagaaccacgtctagtactcgagaactaaagtcgaaccacgccgtaggaacgacggaccgaaggaccgacggtacttaagttacgttaacgttacgtaggtacgacggaaggaacgaacggaaccgtacgaccctaacgg

SEQ ID NO: 265585 - DNA, 558 bp, Homo sapiens
  misc_feature: GYAE6OF02FG22P.34.26.C04.1.454.CMB.1.raw
  modified_base (162)..(162): a, c, t, g, unknown or other
  misc_feature (162)..(162): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (441)..(441): a, c, t, g, unknown or other
  misc_feature (441)..(441): n is a, c, g, or t
  modified_base (503)..(503): a, c, t, g, unknown or other
  misc_feature (503)..(503): n is a, c, g, or t
  modified_base (522)..(522): a, c, t, g, unknown or other
  misc_feature (522)..(522): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccncgttgctcttttaagaggtgtccagtgtcaggtgcagctggtggagtctgggggagcgtggccccagcctggggaccgtccctgagacctctcctggtgcagcgtctggattcaccttcagtagtcatggcatgcacgtggtccncaggcctccgagggccaaggggctagggagtggggtgcagttanagtggtatgatgggaagtagtacaaatactatgcagactccgtagaacggtccatccacgtctaccagacgaacaactacccaagaaccncgactgtactactagactaaactcgaaccctagcctagacgacgccgaaggaccaaccggtnttaactcgtaatttaccgnggttagacggaggagacgaaccgacgacccgtaacg

SEQ ID NO: 265586 - DNA, 686 bp, Homo sapiens
  misc_feature: GYAE6OF02HNFCI.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccaggccgtgggacgtccctgagacctctccgtgtgcagcgtctggattcaccttcagtagtcatggcatgcacgtgggtccncaggcctccgaggcaaggggctgggaggtgggtggctagttatagtggtatgagtggaaagtagtcaaagttactagtcggactaaggtaccgttaccggtagggtaaaccggggtacccgtaacgtttacccgaacccggttcctacccggaaggtaacgaaccgtaaacgttaaccccgaaaaggaaaccgaccgtacgttacggtaacttaccgtacgaacctaaaagtcggaaacccgtacggtaccttaagggaacgaaccggacccggaaacggacccgtaaccgggtactaacggtttacggttaactttaccggtacggtacggaccgggtaaggtaacggaacggtaaccgtaccggtaccctaaccgg

SEQ ID NO: 265587 - DNA, 562 bp, Homo sapiens
  misc_feature: GYAE6OF02GH2U0.34.26.C04.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggattcaccttnagtagtcatggcatgcacgtgggtcccnccaggcctccgaggcgaagggggctgggaggtggggtggctaggttatagtggtatgagtggaagtagtacaaattactagtgacaagacctcggtaggaacgggccgtattccaccgttctaccgaggaacgacaactacccaaagaaccacgctagtactcgtagacaaatcgaaccagaccgtagaacgacgaccgaggaccgacggtactaagtagtacttacgtgtacgacgaggagacgacgacgcctacg

SEQ ID NO: 265588 - DNA, 513 bp, Homo sapiens
  misc_feature: GYAE6OF02FNBIC.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcactgggtccgccaggctccaggcaaggggctggagtggggtgcagttatagtggtatgatggaagtagtcaatactatgcagactccgtgaagggccattcaccgtctccagagacaactccaagaactacgctagtacttctgactaaatcgaaccagccctagacgagccgagaccgacggctaagtgtattacgtgtagcgagagagacagacctacg

SEQ ID NO: 265589 - DNA, 519 bp, Homo sapiens
  misc_feature: GYAE6OF02G8WRB.34.26.C04.1.454.CMB.1.raw
  modified_base (503)..(503): a, c, t, g, unknown or other
  misc_feature (503)..(503): n is a, c, g, or t
tcagtacacgtgatcacgaccggtgctcgatttagtctagcgactttgggtttgggactgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactggggtccgcccgaggcctccgagggcgaaagggggctgggaggtggggtggcagttatagtggtatgatggaagtgtacaatactatgcagactcgtagaggccgattcatcgtactcagagacaactacccaagaacacgctagtactctacgacaaatcgaccacgcctagaagacgccgaggaccgacggctatgtattacgtgngcgagagacgcagccg

SEQ ID NO: 265590 - DNA, 589 bp, Homo sapiens
  misc_feature: GYAE6OF02JBXA8.34.26.C04.1.454.CMB.1.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctggagactctcctgtgcagcgtctggattcaccttcagtagtcatggcatgcacgtcgggtccnccaggcctccagggcaaggggctgggagtggggtgctagttnagtggtatgatcggaagtagtcaatactagtgactagaccgtcggaggaacgggcgaacttccgaccggtctacccgtagacgaacaacttacccaagaaccaccggctagtactactggaaccaaagtccgaacccacggtacctacggagtaacggaccgaaggacccgaggacccttaagtacgttaacttaccgtggttacggacggtaaggaaccgaggaaccgtacggacctaccgg

SEQ ID NO: 265591 - DNA, 499 bp, Homo sapiens
  misc_feature: GYAE6OF02I5CJT.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcttgggggaggcgtggcccagcctgggactccctgagactctcctgtgcagcgtctggattcaccttcagtagtcatggcatgcactgggtccgccaggctccaggcaaggggctgggagtggggtggcagttatatggtatgatggaagtagtcaatactatgcagactccgtgaagggccgatcaccgtctccagagacaatcccaagaacacgactgtatctgacaatcgaccagcctgagacgcgaggacacggctatgtattactgtgcgagagagacagcctacg

SEQ ID NO: 265592 - DNA, 519 bp, Homo sapiens
  misc_feature: GYAE6OF02HNQ0K.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtgggtccgccaggctccaggcaaggggctgggagtggggtggcagttatatggtatgatggaagtagtcaatactatgacagactcgtggaagggccgtatcaccgtctccagacgacaactacccaagaaccacgctagtactctagacaatcgaccagcctgacgacgccgaggaccacggtctaagtgtattacgtgtggcgagagaggacacgcctacg

SEQ ID NO: 265593 - DNA, 533 bp, Homo sapiens
  misc_feature: GYAE6OF02HF6UM.34.26.C04.1.454.CMB.1.raw
  modified_base (303)..(303): a, c, t, g, unknown or other
  misc_feature (303)..(303): n is a, c, g, or t
  modified_base (459)..(459): a, c, t, g, unknown or other
  misc_feature (459)..(459): n is a, c, g, or t
  modified_base (527)..(527): a, c, t, g, unknown or other
  misc_feature (527)..(527): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggatttcacctttcagtagtcatggcatgcactgggtccncaggctccgaggcaaggggctgggagtggggtggcaggttatagtgggtattgagtgggaaagttacgtcaaattactatgcaagctccggtaggaacgggccgaattcgacccgtctaccagagaccaactacccaagaaccacgctagtactcngacaaatcgaaccagcctagacgacgccgaggacacggctagtgtatacgtgtgacgagagagacgancctacg

SEQ ID NO: 265594 - DNA, 541 bp, Homo sapiens
  misc_feature: GYAE6OF02JD5PF.34.26.C04.1.454.CMB.1.raw
  modified_base (299)..(299): a, c, t, g, unknown or other
  misc_feature (299)..(299): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcactggtccncaggctccaggcaaggggctgggagtggggtgcagttatagtggtatgatggaagtgtacaatactatgcagactcgtagacgggctatcaccgtctccgagacgacaactacccaagaaccacgcgttacgtagttctaggacctaaagtcgaacccgacgaccgtaggaacgtacggaccgaggaccgacggtactagttacgttaattaccgtgtagacgaggagacgacacgcctacg

SEQ ID NO: 265595 - DNA, 640 bp, Homo sapiens
  misc_feature: GYAE6OF02I92FV.34.26.C04.1.454.CMB.1.raw
  modified_base (177)..(177): a, c, t, g, unknown or other
  misc_feature (177)..(177): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggaggcgtggcccaggcctgggaccgtccctggagacctctcctgtgcagcgtctggattcaccttcagtagtcatggcatgcactggtccgcaggcctccaggcgaaggggtctgggagtggggngcagttanagtggtatgagtggaaagtagtacaaatactatgacagtacctccggtagaacgggaccgtacgttaccgaccgttaccgtaccgtaagaacgaacaacgttaacccgaaacgaaacaaccgtacgtacgtacgtcgtagaacctaaagtacgaaccgaacgtaccctgaacggtaacgacccgacgggaacgtaccgggtaccgttaacgttacgttaacgtttaaacggtcggttaacggtaccggtaagtaaccgggaagaacccggtaaccggtacccgtaaacccgg

SEQ ID NO: 265596 - DNA, 801 bp, Homo sapiens
  misc_feature: GYAE6OF02H2FW7.34.26.C04.1.454.CMB.1.raw
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggcccagccgtgggaccgtccctgacgacctctccgtgtcgcagcgtctggacttcacctttcagtagtcatggcatgcacgtcgggtccnccgaggcctaccgaggccgaaggggctagggagtggggngctagttactagtggtatgagttgggaaagttagtactaaattacgtagtcgactaacggtaccgttaccggtagggtaaaccggggtcccgttaaacttacccggtaacccggttccgttacccgaaacgggtaaccggtaaaccctaaaaccgttacccccgaaaaggtaaacccgtacccggtacgtttaacggtaaccgtttacccgttaacggtaaacccgtaaaacggttacccggaaacccgtaaccggttaccccgttaacggggaaacgaacccggggtaacccgggtaaaccgggtaacccggttaacccggggtaccgtttaaacggtttaaccgggtttaaaccgtttaacccggttacgggttaaccgggtaccggggtaaacgggtaaaccgggtaaccgggaaacccgtacccggtaaccccgttaacccggg

SEQ ID NO: 265597 - DNA, 538 bp, Homo sapiens
  misc_feature: GYAE6OF02I8YTW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctggggggaggcgtggcccagcctggggacgtccctgagactctcctgtgcagcgtctggattcaccttcagtagtcatggcatgcactgggtccgccaggcctccaggcgaagggggctgggagtggggtggctagttatagtggtatggataggaagtgtacaatactatgcagtactccggtagacgggccgtattccaccgtctaccagaacgacaactacccaaagaaccacgctagtactcaggacaaatcgaccagtcctagagacgaccgaggacacggctaatgttacttacgtgtagcgaggacgagacgagccctaacg

SEQ ID NO: 265598 - DNA, 503 bp, Homo sapiens
  misc_feature: GYAE6OF02FH0LE.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccgccaggcctccaggcaaggggctgggagtggggtgcagttatagtggtatgatggaagtagtcaatactatgcagactcgtgaaggccgattcaccgtctccagagacaatcccaagaacacgctgtactctgacaaatcgaccagcctagacgagccgaggacacggctaatgtacttactgtgcgagagagacacgccacg

SEQ ID NO: 265599 - DNA, 528 bp, Homo sapiens
  misc_feature: GYAE6OF02GMR9Q.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccaccgaggctccgaggcaaggggctgggagtgggtggcaggttatagtggtatggataggaagtagtcaatactatgcagactcgtgaacgggccgattcaccgtctccagacgacaactccaagaaccacgactgtactctgacaaagtcgaccgagcctgacgagaccgagggacacggactaagtagttacttacgtgtaggacgaggagagacgacgcctaacg

SEQ ID NO: 265600 - DNA, 513 bp, Homo sapiens
  misc_feature: GYAE6OF02F7GRJ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtggggtcccgccgaggcctccgaggcaagggggctgggagtggggtggcagttatagtggtatgatggaagtagtacaatactatgcagactcgtagaagggcgatcgaccgtctcagagacaatccaagacacgctagtatctgacaatcgaccacgctgacgagccgaggacacggactaatcgtatacgtgtagacgagagagacgacgcctacg

SEQ ID NO: 265601 - DNA, 558 bp, Homo sapiens
  misc_feature: GYAE6OF02J3EIM.34.26.C04.1.454.CMB.1.raw
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtgagtctgggggagcgtggcccagccctgggactccctgagactctcctgtgccaggcgtctggacttcaccttcagtagtcatggcatgcacgtggtccncaggctccagggccaaggggctgggagtggggtgctaggttatgtgggtatggatgggaagtagtcaaagttctatcggacagtaccgtcgtaggaacgggtccaagttccgaccgttctccgaagacgacgaactacccaaagtaccacgactgatctgacaatcgaccagcccgtagacgagtccgagacacggtacgtagttcggtaattaccgtagtcgacggtaggacgtaacgaccggtacgacctacgg

SEQ ID NO: 265602 - DNA, 522 bp, Homo sapiens
  misc_feature: GYAE6OF02F0UH4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcactgggtccgccaggctccaggcaaggggctggagtggggtgcaggttatagtggtatgatggaagtgtcaatactatgcagactccgtgacggccgattcaccgtctccagacgacaatcccaaagacacgctgtactctgacaaatcgaaccagcctgaacgacgaccgaggaccgacggtctaagtgttaacttacgtgttagacgaggagaggacagccctaacg

SEQ ID NO: 265603 - DNA, 606 bp, Homo sapiens
  misc_feature: GYAE6OF02GZD7C.34.26.C04.1.454.CMB.1.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctctttaagaggtgtccagtgtcaggtgcagctggtggagtctgggggagcgtggcccagcctgggacgtccctgagactctcctgtgcagcgtctggattcaccttnagtagtcatggcatgcacgtcgggtcccnccgaggcctaccgagggcgaagggggctgggaggtggggtcggctaggttatagtggtatgagtggaagtagtacaatactagtgacagtactccggtagacgggcgtactccgacgtcacgtagacgactaactaccgaaacgaacacgtactacgtactcgtacgaactaacgtcgaaccgtacgtaccgtaggaacggaacggtcccggaaggaccgaaccggtacgttaagttacgttaacgttacgttaggtacggtacggtaacggacggtaacggaccgtacggaccctaaccgg

SEQ ID NO: 265604 - DNA, 511 bp, Homo sapiens
  misc_feature: GYAE6OF02GSBC6.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccnccaggcctccgaggcaaggggctgggagtggggtggcagttatagtggtatgatggaagtagtcaatactatgacagactcgtagaacgggccgattcaccgtctaccagacgacaactcccaagaacacgctgtactctgacaaatcgaccagcctgagacgccgaggacacggctatgtattacgtgtgcgagagagacacgcctacg

SEQ ID NO: 265605 - DNA, 682 bp, Homo sapiens
  misc_feature: GYAE6OF02HNIA5.34.26.C04.1.454.CMB.1.raw
  modified_base (179)..(179): a, c, t, g, unknown or other
  misc_feature (179)..(179): n is a, c, g, or t
  modified_base (344)..(344): a, c, t, g, unknown or other
  misc_feature (344)..(344): n is a, c, g, or t
  modified_base (452)..(452): a, c, t, g, unknown or other
  misc_feature (452)..(452): n is a, c, g, or t
  modified_base (535)..(535): a, c, t, g, unknown or other
  misc_feature (535)..(535): n is a, c, g, or t
tcagtacacgtgatcacgaccggtgctcgatttagtctagcgactttgggtttggggcgtgggagaggagcccagcactagaggtcggcgggtgtttccattcggtgatcagcactgaacacagaggactcaccatggagtttgggctgagctgggttttcctcgttgctcttttaagnggtgtccagtgtcaggtgcagctgggtggagtcgtgggggagcggtcggcccaggcctggggacgttcccgtggacgaccttcgtcctggtacgcgagcgttcgtgggacttccaccgtttcaggttacgtcaagtgggctactggaccacgttcggggtccccncctaagggccttacccgagggcggaagggggctgggtacggtgggggtacgcgtaagttataggtgggtactggaagttggaaagtagtccaaagtacttagtcgganaacgtacctccggtagacgggccgtaattccgacgttccacgagtaagacaacttacccgaaagtaccaacggtctagtaacncgtagactaacgtacgacccgtagaccgtggaaacgccgggtaaccgacgggaaccctacggggtacctaacgttacggttaactttacggtaccggtacggacggtaacggaacggtaaccggaacaaccggtaccccgtaaccgg

SEQ ID NO: 265606 - DNA, 539 bp, Homo sapiens
  misc_feature: GYAE6OF02GGMJQ.34.26.C04.1.454.CMB.1.raw
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccctcgttgcttcttttaagaggtgtccagtgtcaggtgcagctggtggagtcgtgggggagcgtggcccagccgtgggaccgtccctgagactctcctgtgcagcgtctggattcaccttcagtagtcatggcatgcacgtgggtcccnccgaggcctccgaggcgaaggggctgggagtggggngctaggttatagtggtatgagtggaagtgtacaattactatgcaagcctcgtaggaacgggccattccaccgtctccgaagacgaacaactacccaaagaaccacgcctagtactctgacaaatcgaaccagcctagagacgccgaggaccacggactagtgttaattacgtgtgacgagagagacagccctacg

SEQ ID NO: 265607 - DNA, 550 bp, Homo sapiens
  misc_feature: GYAE6OF02G67TT.34.26.C04.1.454.CMB.1.raw
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagccgtccggattcaccttcagtagtcatggcatgcacgtgggtcccnccgaggcctccgaggcgaagggggctgggagtgggtggctagttatagtggtatgatggaagtagtacaatactatgacagtacgtccggaggaacgggcctattccgaccgtctccgagacgacaactccaaagacacgctagtactctagactaatcgaccagcctagacgacgaccgaggaccacggactagtcgttaacttacgtggtacgacgaaggagacgacgacgtacccacgtacgg

SEQ ID NO: 265608 - DNA, 618 bp, Homo sapiens
  misc_feature: GYAE6OF02H5JBB.34.26.C04.1.454.CMB.1.raw
  modified_base (175)..(175): a, c, t, g, unknown or other
  misc_feature (175)..(175): n is a, c, g, or t
  modified_base (277)..(277): a, c, t, g, unknown or other
  misc_feature (277)..(277): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (493)..(493): a, c, t, g, unknown or other
  misc_feature (493)..(493): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgctctttaagnggtgtccagtgtcaggtgcagctggtggagtcgtgggggagcgtggcccagcctgggacctccctgacgcctctcctgtgcagcgttctggacttcaccttnagtagtcatggctatgccacgtgggtcccncaggcctcgaggcaaggggctgggaggtgggnggactaggttataggtgggtactgattacgggaagtagtcaaaattacctagtggactaagtaccgtccggtaggaacgggtcccgtaatttcccgaccgttcctaccgaagacgtaacaactcccgaaagaaccgacgtctagtaacttcganacaaacgtcggaaccctagcctggaaacgtaccggaccgaacggaccgtaccggtacgttaagttacggttaacttacggtcgtaggaccggaaggaaggaaccgtaccgtacggccctaaccgg

SEQ ID NO: 265609 - DNA, 581 bp, Homo sapiens
  misc_feature: GYAE6OF02IR1P4.34.26.C04.1.454.CMB.1.raw
  modified_base (550)..(550): a, c, t, g, unknown or other
  misc_feature (550)..(550): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgacgactctcctgtgcagcgtctggattcaccttcagtagtcagtggcagtcgcacgtcgggtccgccgaggcctccgagggcgaaggggctagggaggtggggtggctaggttatagtggtatggaatgggaagttagtactaaatactaatgcaagtacgtaccggtaggaacgggccgtattccgaccgttcaccgtaagaacgaacaactacccgaaagaaccaccgactagtactcgtacgaactaatacgaccacgtccaggaacgacggaccgaaggaccgaggactagttagtacttacgngtacgacgacggaagagacgacgcctaacgg

SEQ ID NO: 265610 - DNA, 641 bp, Homo sapiens
  misc_feature: GYAE6OF02HEMCH.34.26.C04.1.454.CMB.1.raw
  modified_base (241)..(241): a, c, t, g, unknown or other
  misc_feature (241)..(241): n is a, c, g, or t
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactcccngagactctcctgtgcagcgtctggattccaccttcagtagtcagtggcatgcacgtcgggtcccnccaggcctccgaggcgaaggggctgggaggtggggtggctaggttatagtggtatggaagtagggaaagttagtactaaaattactagtgaccgtaagtaccgtaccggtagggaacgggtcccgtaacgttccgaacccggttcctaccgaaggacgtaaccaaccttacccgaaaagaaccaccgtacttacgtacttacgtacgaactaaacgtcgaaccctagcccgtaaggaacggaccggaccgaacgggaccgaacgggtaccttaagttacggttaacttaacgttaggtacgacggaaggacgaacgaaccgaccgacccgtaacg

SEQ ID NO: 265611 - DNA, 620 bp, Homo sapiens
  misc_feature: GYAE6OF02IUMRA.34.26.C04.1.454.CMB.1.raw
  modified_base (181)..(181): a, c, t, g, unknown or other
  misc_feature (181)..(181): n is a, c, g, or t
  modified_base (310)..(310): a, c, t, g, unknown or other
  misc_feature (310)..(310): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttcttttaagaggtntccagtgtcaggtgcagctggtggagtcgtgggggagcgtggcccagcctgggactccctgagactctcctgtgcagcgtctggacttcaccttcagttagtcagtcggacatgcacgtcggggtcccnccgaggcctccgagggccaaggggtctgggagtggggtgctaggttatagtggtatggagtggaaagtagtacaaagttactagtcgacagtaccgtccggtaggaacggggtccctaagttcccgtacccgttcctaccgaaggtaacgaacctaaaccgtacccgaaacgaaccaccgtacgttacgtacgttccgtagacctaaagtcgaaccgacgtccgtagacggacgaccggaaggaccgtacggtacttaagtacgttaacttacgtggtcgtacggagacggaacgaccacgccctaacgg

SEQ ID NO: 265612 - DNA, 534 bp, Homo sapiens
  misc_feature: GYAE6OF02G6S5J.34.26.C04.1.454.CMB.1.raw
  modified_base (374)..(374): a, c, t, g, unknown or other
  misc_feature (374)..(374): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggactccctgagactctcctgtgcagcgtctggattcaccttcagtagtcatggcatgcactgggtcctcaggcctccgaggcaaggggctgggagtggggtgcagttatagtggtatggatggaagtagtcaatactangacagactccgtggaagggccgtattcgacccgtctaccgaagacgaacaactacccaaagaaccacgctacgtatctagacaaatcgaaccagcctgacgagccgagacgacggctaagtcgtattacgtgttacgacgtagtagagacacgacctacg

SEQ ID NO: 265613 - DNA, 564 bp, Homo sapiens
  misc_feature: GYAE6OF02GL9TN.34.26.C04.1.454.CMB.1.raw
  modified_base (312)..(312): a, c, t, g, unknown or other
  misc_feature (312)..(312): n is a, c, g, or t
  modified_base (390)..(390): a, c, t, g, unknown or other
  misc_feature (390)..(390): n is a, c, g, or t
tcagtacacgtgatcacgaccggtgctcgatttagtctagcgactttgggtttgggggctgggagaggagcccacgcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgacgactctcctgtgcagcgtctggatttccaccttcgagtagtcatggcatgcacgtcggggtccnccgaggcctccgaggcaagggggctgggaggtggggtgctagttatagtggtatgaatggaagtagtacaattactangacagactcggagacgggccattccaccgtctaccgagacgactaactacccaaagaaccacgcttagtatcctgacaaagtcgaaccacgcctaggaacggacgaccgaaggaccgacggtactaagtgttaacttacgtagtgacggtagaacgagaccgacgaccctaacg

SEQ ID NO: 265614 - DNA, 588 bp, Homo sapiens
  misc_feature: GYAE6OF02GABQU.34.26.C04.1.454.CMB.1.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (338)..(338): a, c, t, g, unknown or other
  misc_feature (338)..(338): n is a, c, g, or t
  modified_base (382)..(382): a, c, t, g, unknown or other
  misc_feature (382)..(382): n is a, c, g, or t
tcagtacacgtgatcacgaccggtgctcgatttagtctagcgactttgggtttggggtctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgacgactctcctgtgcagcgtctggattcaccttnagtgtcatggcatgctacgtgggtccncaggctcgtaaggcaaggggctgggagtgggggtnactaggttatagtggtactgactgggaatgtacaaagtactagnggacagtacctccggtaggaacgggtcctattccgaaccgttctccgaagtaccgaactaacgttcccgaaagaccacggcttagtactcgttagaactaaagtcgaaccacggccttaaggacgaccggaccggaacgaccacgggtactaagtacgttaattaccgtggtacgacggacggtaagacgacgtaccggcctaacg

SEQ ID NO: 265615 - DNA, 644 bp, Homo sapiens
  misc_feature: GYAE6OF02IQ4MK.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgacgactctcctgtcgcagcgtctggattcaccttcagtagtcagtggcattgctacgttcggggtcccgccgaggcctccgagggccgaaggggctgggaggtggggtggctaggttatagtggtaagtgagtagggaagttagtacaattactatcgactagaccgttccgtaaggaacgggtccctaagttcccgaccgttcctaccgaaggacgaacctaaacgttaccccgaaaagtaacccgaccggtccttaaggtaccttactacggaaaccaaaagttccggaaacctacggaccgttaagggaaaccggtacggaccggaacggacccgaacggtcttaaagttcgttaagttccgtaggtcgacggaagagaacgacacgacctaacgg

SEQ ID NO: 265616 - DNA, 582 bp, Homo sapiens
  misc_feature: GYAE6OF02ISM25.34.26.C04.1.454.CMB.1.raw
  modified_base (276)..(276): a, c, t, g, unknown or other
  misc_feature (276)..(276): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacctccctgagactctcctgtgcagcgtctggattcaccttnagtagtcatggcatgcacgtgggtccgccaggcctccgaggcgaagggggctgggaggtggggtggctaggttatagtggtaatggagtagggaaagttacgtacaaatactagtcgactaacggtaccgtaccggtaggaaacggggcccgtaagttccgacccgttctaccgaagaacgaccaactacccgaaagaaccacgcttagtactcgtagaactaaagtcgaccagcctagagacgcgaggacgacgcgtagtagttacgttacgtggtagacggtagacgacgacgacgacctaacg

SEQ ID NO: 265617 - DNA, 554 bp, Homo sapiens
  misc_feature: GYAE6OF02IF3H4.34.26.C04.1.454.CMB.1.raw
  modified_base (303)..(303): a, c, t, g, unknown or other
  misc_feature (303)..(303): n is a, c, g, or t
  modified_base (520)..(520): a, c, t, g, unknown or other
  misc_feature (520)..(520): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcacgtgggtccnccaggctccaggcgaaggggctgggagtggggtgcagttatagtggtatggataggaagtagtacaattactagtgacaaggacctccggtaggaacggggcccgtatttaccgacccgttacctaccgaaggacgaaccaaactaccccgaaagaaccacgtactagtactctacgaactaaagtcgaaccagcctagagacgaccgagacacggntagtgtattcgtgtgcgagagagacacgaccacg

SEQ ID NO: 265618 - DNA, 555 bp, Homo sapiens
  misc_feature: GYAE6OF02HD3GT.34.26.C04.1.454.CMB.1.raw
  modified_base (177)..(177): a, c, t, g, unknown or other
  misc_feature (177)..(177): n is a, c, g, or t
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtctgggggagcgtggcccagccgtgggaccgtccctgacgactctcctgtgcagcgtctggattccaccttnagtagtcagtggcatgccacgtgggtcccncgaggcctccgaggcaagggggctgggacgtgggtggcagttatagtggtanggatggaagtacgtcaaattactatgactagacctccggtagaacgggccgattccacgtctaccgagacgtacaactcccaaagaaccacgtctagtaactctagacaaagtcgaaccagtccgtagacgacgaccgacggacacggtactaagtcgttaattacgtgtagacggagagacgacacgtccacg

SEQ ID NO: 265619 - DNA, 571 bp, Homo sapiens
  misc_feature: GYAE6OF02F5NM6.34.26.C04.1.454.CMB.1.raw
  modified_base (196)..(196): a, c, t, g, unknown or other
  misc_feature (196)..(196): n is a, c, g, or t
  modified_base (308)..(308): a, c, t, g, unknown or other
  misc_feature (308)..(308): n is a, c, g, or t
  modified_base (339)..(339): a, c, t, g, unknown or other
  misc_feature (339)..(339): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggcccaggcctgggaccgtccctgacgactctcctgtgcagcgtctggattcaccttcagtagtcatggcatgcacgtgggtcccncaggcctccaggcaaggggctgggagtgggngcaggttatagtggtatgagtaggaagtagtacaatactatcgctagtacctccggtagacggggcctagttccacccgtcctaccgagacgacaactacccgaagaaccacgtctgtactcgtagactaaagtcgaacctacgcctagacgacgccgaacggaccgacggtactaattacggttattaacgtggtaggacgaggtaacggacggaccgtaccgaccctacg

SEQ ID NO: 265620 - DNA, 633 bp, Homo sapiens
  misc_feature: GYAE6OF02IUZCQ.34.26.C04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtncagctggtggagtctgggggagcgtggcccagccctgggaccgtccctgagactctcctgtgcagcgtctggattcaccttnagtagtcatggcatgcacgtgggtccnccaggcctccgaggcaagggggctgggaggtggggtgctaggttatagtggtatgagtggaagtagtacaaattactagtgaccagacctccggtaggaaacgggccgtaattccgaacccgttctacccgaaggaacgaaccaaacgttaccccaaaaggaacccacgtaccttagtaacttccgtagaaccaaagtccgaacccagtcccgtaaggaacggaacggacccggaacgggaaccgtaccgggtaccttaagttaccggttaactttaaccgtcggtaggaccggtaaggaccggaaggaacccgacggtaccctaacgg

SEQ ID NO: 265621 - DNA, 571 bp, Homo sapiens
  misc_feature: GYAE6OF02ISSCI.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcacgtgggtcccgccaggcctccgagggcaaggggctgggagtggggtgcagttatagtggtatgagtggaagtagtacaatactatgcagactcggtaggaacgggccgattccaccgtctaccaggacgacaactacccaaagaaccacgctagtatactagactaaatcgaaccagcctaggaacgacgaccggaaggaccgaacggtactaagttacggttaactttaacgtggtaggtaccggaaggtacggaacggaacgaccgaccctaacgg

SEQ ID NO: 265622 - DNA, 554 bp, Homo sapiens
  misc_feature: GYAE6OF02F8Y5P.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccaggctccgaggcaaggggctgggagtggggtgcagttatagtggtatggatggaagtagtacaatactatgacagactcgtagacgggccgattcaccgtctccgagacgacaactccaagaacacgactgtatctagaactaatcgaaccagcctagaacgacgaccggaggaccgacggtactaagttacggttaacttaacgtggtacgacggtaaggaacggaacggaaccgacggacctaaccgg

SEQ ID NO: 265623 - DNA, 552 bp, Homo sapiens
  misc_feature: GYAE6OF02HSCHR.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggaggcgtggcccagccctgggacgtccctgacgactctcctgtgcagcgtctggattcaccttcagtagtcatggcatgcactgggtcccgccaggcctccaggcgaagggggctgggagtggggtggctagttatagtggtatgagtggaagtagtcaatactatgacagactcgagaaggccgatccgaccgtctcgagagacaactacccaaagaacacgctagtactctagacaaatcgaaccagtcctaggagacgaccgaaggaccgacggtactaagttacgtaacttacgtaggtacggacggtagaggacgacgacgaccctaacgg

SEQ ID NO: 265624 - DNA, 521 bp, Homo sapiens
  misc_feature: GYAE6OF02GXW6R.34.26.C04.1.454.CMB.1.raw
  modified_base (304)..(304): a, c, t, g, unknown or other
  misc_feature (304)..(304): n is a, c, g, or t
  modified_base (436)..(436): a, c, t, g, unknown or other
  misc_feature (436)..(436): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtcccnccaggcctccaggcaaggggctgggagtggggtgcagttatagtggtatggatggaagtagtcaatactatgcagactcgtgaaggccgattcaccgtcaccagacgacaactcccaaagaacacgctgtanctagacaaatcgacagcctgacgagccgaaggacacggactagtacgttaattacgtgttcgacgaagaggagacacgacctacg

SEQ ID NO: 265625 - DNA, 709 bp, Homo sapiens
  misc_feature: GYAE6OF02HSV4S.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcgtcgtaggctctttaagaggtgtccagtgtcaggtgcagctggtggagtcgtgggggaggcgtggcccagccgtgggaccgtccctgacgtacctctcctgtgcagcgtctggacttcaccttcagtagtcagtggcagtgacctacggtcggggtcccgaccgacgggcctaccggagggaccgaagggggtctagggtagggtggggtcgactaagttaagtgtagggtataggtagtagggtaaacgtacgtacaaattaccgtagtcggactaacggtacccttaccgggtagggaaccgggtaccgtacttaccgtacccggttacctacgaacggtaacgaaccctaaaccgtaaccccgaaacgtaaccgaaccggtacttagtaaccgtccgtaggtaaaccctaagaccgtaacccgaagtacccgtaggaacggtaccggaccgggaaggtacccgtaccgggtaactaacgttaaccggttaactacggttacggtacgaccggtaaggaacgtaaccggacgtaaccgtcccgtaacgg

SEQ ID NO: 265626 - DNA, 544 bp, Homo sapiens
  misc_feature: GYAE6OF02F931J.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcacgtgggtccgccaggcctccgaggcaaggggctgggaggtggggtggctagttatagtggtatgatggaagtagtcaatactagtgacagactccgtagaacgggccgattccgaccgtctaccgagacgacaactacccaaagaacacgctagtactctagactaagtcgaccagtccgtagagacgaccgaggacgacggacgtaagtagtacttacgtgtgacgaggagacggacgacgacctacg

SEQ ID NO: 265627 - DNA, 887 bp, Homo sapiens
  misc_feature: GYAE6OF02GQKHN.34.26.C04.1.454.CMB.1.raw
tcagtacacgtgatcacgaccggtgctcgatttagtctagcgactttgggtttgggggcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtcggcccaggccgtggggaccgtccctgacgtccttcctccgtggtgcaggccgtcgtggactttccaccttcgaagttagtcagttcggctaagttcgccgtacggttcggggtcccaccgagggtccctaccggaacgggaccggaaacgggggtccttagggggtaagggttgggggtacggtaccgtaaaggttttacgtaaggttacgggtttaatcggggtaaagtttacggggtaaaacggtttacgttaaccgtaaaaacgtttccgtaaggtccggtacctaacggttaacccgttaccgggtaacgggtaaaccggggtccccgttaacgtttacccggtaaccccggttaccgtaacccggtaaacggtaaaccgtaaacccgttaaaaccggttaaccccgtaaaaacggtaacccgtaaccggttaccgttaacggtttaacttaccgggttaacgaaaccgtaaacgttaccggtaaacccgtacggttacccgtaaacgggtaaacggtaaccgggtaacccgggaacgggtaacccgacgggttaacccgttaaggtttaacggtttaaacgttaacggttaccgggttacggaacggttacgggaaacggtaaccgggtaaccgtacccggtaacccgttacccggg

SEQ ID NO: 265628 - DNA, 533 bp, Homo sapiens
  misc_feature: GYAE6OF02GP6LB.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtccgccaggcctccgaggcaaggggctgggagtggggtgcagttatagtggtatgagtggaagtagtacaatactatgcagtactccgtagaacgggctattcgaccgtctacaagacgaacaactacccaagaaccacgctgtatctagactaaatcgaccacgactagagacgaccgaggacgacggtacgtaatagttactacgtggtgacggtagagagacacgacctacg

SEQ ID NO: 265629 - DNA, 528 bp, Homo sapiens
  misc_feature: GYAE6OF02GRQXZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtcccgccaggcctccgaggcaaggggctgggaggtggggtggctaggttatagtggtatggatggaagtgtacaatactatgcagactcgtagaaggccgtatccaccgtctaccagacgacaatacccaagaaccacgctagtatctagactaaagtcgaaccagcctagacgagccgaggacacggactaagtgttattacgtgtgacgagagagacacgcctaacg

SEQ ID NO: 265630 - DNA, 565 bp, Homo sapiens
  misc_feature: GYAE6OF02IOWN4.34.26.C04.1.454.CMB.1.raw
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (462)..(462): a, c, t, g, unknown or other
  misc_feature (462)..(462): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtctgggggagcgtggcccagcctgggactcctgagactctcctgtgcagcgtctggattcacttcagtagtcatggcatgcacgtggtccgccaggctccagggcaaggggctggagtggggtcggcagtagtatggggtangaagttgggaaacgtaggtcaaagtactaangacgagtacgtccgtaggaaacgggtccggactttcgaacccgttcgtacccaggaagtaaccaaattcccaaagaaaacccncgactgtactactagacaaatacgaaccacgcgagagacggaccgacgacgtacgntaagtgttaactacgtgtagacggaacgagaacgacgacgtccgaac

SEQ ID NO: 265631 - DNA, 732 bp, Homo sapiens
  misc_feature: GYAE6OF02GF3T3.34.26.C04.1.454.CMB.1.raw
  modified_base (307)..(307): a, c, t, g, unknown or other
  misc_feature (307)..(307): n is a, c, g, or t
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtctgggggagcgtggcccagcctgggactccctgagactctcctgtgcagcgtctggattccaccttcagtagtcagtggcatgccacgtggggtcccnccgaggcctccgaggccgaaggggcctgggagttggggnggctaggtttanagtggggtaactggaacgtggtaacgttagtacctaaaagttccgttaagtcggaccgaacgttaacccgttcccggtaaggggtaaaccggggtccccgttaactttacccgggacccccgtttccgttaaccccggaacggtaaccgaaaccgtaaaccgttaaccccccgaaaaggaaacccgtaccgggtaacccgttaggtaaccgttaccgtaccggaaaccttaaaacgttcggaacccgtaaccggccgttaacggaacggaaccggacccgggtaacggaccgtacccgggacttaaccgttagttactttaaccggtacgtaggaccggataaaccgggactaaccggacggtaccctaaccgg

SEQ ID NO: 265632 - DNA, 607 bp, Homo sapiens
  misc_feature: GYAE6OF02FVNZ4.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggaccgtccctgagactctcctgtgcagcgtccggattcaccttcagtagtcatggcatgcacgtcgggtccncgaggcctccgaggcgaaggggctggaggtgggtgctagttagtagtggtatggagtagggtaagtagtacaattactatcgacaacgtaccgtccggtagggaaacggggcccttaagttcccgacccgttcctaccgaaggaacgaaccgaaacctacccgaaagaaccgtaccgtctagtacctcgtacgaactaaagtcgaaccacgtccgtagacgaacggaccgaggaccgacggtacttagtgttaacttacggtgtacggacggaagacggaacgacgacgcccgtaacgtcgg

SEQ ID NO: 265633 - DNA, 541 bp, Homo sapiens
  misc_feature: GYAE6OF02HJS14.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgacgactctcctgtgcagcgtctggattcaccttcagtagtcatggcatgcactgggtccgccaggcctccgaggcaaggggctgggagtgggtgctagttatagtggtatgagtggaagtgtacaatactatgctagactcggtaggaacgggccgtattccgaccgttctaccgagacgaaccaacttacccaaagaaccacgctagtactctacgactaaatcgaaccagacctagaacgacgaccgaggaccacggactaagtgttattacgtgtgacgagagagacagccctacg

SEQ ID NO: 265634 - DNA, 624 bp, Homo sapiens
  misc_feature: GYAE6OF02HV0TY.34.26.C04.1.454.CMB.1.raw
  modified_base (215)..(215): a, c, t, g, unknown or other
  misc_feature (215)..(215): n is a, c, g, or t
  modified_base (409)..(409): a, c, t, g, unknown or other
  misc_feature (409)..(409): n is a, c, g, or t
tcagtacacgtgatcacgaccggtgctcgatttagtctagcgactttgggtttggggtcgtgggaggaggaggcccagcactagaggtcggcggtgtttccattcggtgatcagcactgaacacagaggactcaccatggagtttgggctgagctgggttttcctcgttgctctttaagaggtgtccgagtgtcaggtgcagctggtggagtcgngggggagcgtggcccagcctgggacgtccctgagactctcctgtgacgagcgtcgtggacttcaccttcacgtagtcagtggcatgcatcgggtccgccgaggctccgcggcgaaagggggctgggacggtggggtcggacgtaggttatagtcgggtaatgacgtaggaaggtagtcgaaatactaagtgacnggaacctcggtaggaacgggccgtatccgaaccgtctaccgaagtagaccaaactacccgaaagaaccacggtactcggtaatacgttacgactaaaacgtcgaaacccagtacccgagtaacggacgaaccggagaacccgtacggtctaaacggttgttaacgttaacgtggtcggtacggaacggacggaacggaaccgtgaaccctaacgg

SEQ ID NO: 265635 - DNA, 548 bp, Homo sapiens
  misc_feature: GYAE6OF02GV4YY.34.26.C04.1.454.CMB.1.raw
  modified_base (298)..(298): a, c, t, g, unknown or other
  misc_feature (298)..(298): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagaggtgtccagtgtcaggtgcagctggtggagtctgggggagcgtggcccagcctgggactcctgagctctcctgtgcagcgtctggattcaccttcagtagtcatggcatgcacgtgggtccncaggcctccgaggcaaggggctgggagtggggtgcagttatagtggtatgatggaagtagtacaatactatgacagactcgagaacgggcctaattccgaccgtctaccgagacgaccaactacccaagaaccacgctagtaactcgtagacctaaagtccgaaccgtagccgtagaacgacgccgaagaccgacggactagtagttaactacgtggtacgacgaaggagtaacgacgacgccctaacgg

SEQ ID NO: 265636 - DNA, 562 bp, Homo sapiens
  misc_feature: GYAE6OF02JBOHZ.34.26.C04.1.454.CMB.1.raw
  modified_base (422)..(422): a, c, t, g, unknown or other
  misc_feature (422)..(422): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccgaggcctccgaggcgaaagggggtctgggaggtggggtggctagttatagtggtatgagtggaagtagtcaatactatgcagctcgtgaacgggcatcgaccgtctacagagacaacncccaaagaaccacgctacgtatacgtgaccaaagtcgaaccacgtacctggacgacggaccgaaggaccgacggtacttaacgttagtaacgtttaacgtggttagacggtaggaacggaacggacgacgaccctaacgg

SEQ ID NO: 265637 - DNA, 501 bp, Homo sapiens
  misc_feature: GYAE6OF02FK93L.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccgccaggctccaggcaaggggctgggagtgggtgcagttatatggtatgatgggaatgtacaatactatgcagactccgtgaagggccgattcaccgtctccagacgacaatcccaagaacacgctgtactctgacaatgaccagcctagacgagccgagacgacggactatgtattactgtgcgagagagacacgctacg

SEQ ID NO: 265638 - DNA, 532 bp, Homo sapiens
  misc_feature: GYAE6OF02FQKEK.34.26.C04.1.454.CMB.1.raw
  modified_base (417)..(417): a, c, t, g, unknown or other
  misc_feature (417)..(417): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcacgtgggtccgccaggcctccgagggccaagggggctgggaggtggggtggctagttatatgggtatggatggaagtagtcaaatactatgcagactcgtagaggccattcaccgtctcaganacaactacccaagacacgctgtatctgactaaatcgacagcctagacgacgcggacgacgacggtctaataggtaacttacgtcgtagacggaagaggacgacgacgtcctaacg

SEQ ID NO: 265639 - DNA, 533 bp, Homo sapiens
  misc_feature: GYAE6OF02GP7FC.34.26.C04.1.454.CMB.1.raw
  modified_base (177)..(177): a, c, t, g, unknown or other
  misc_feature (177)..(177): n is a, c, g, or t
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctgggtggagtcgtgggggagcgtggcccagcctgggacgtccctgagactctcctgtgcagcgtctggattcaccttcagtagtcatggcatgcactgggtccncaggctccgaggcaaggggctgggagtggggtggctagttatatggtatgatggaagtgtacaatactatgacagactcgtagaagggccgattcaccgtctccgagacgacaactcccaaagaaccacgctagtactctagacctaaatcgaaccacgaccttggagacggccgaacggacacggactagtagtaattacgtagtgacgaggagagacgacgcctaacg

SEQ ID NO: 265640 - DNA, 584 bp, Homo sapiens
  misc_feature: GYAE6OF02JBUDV.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtcccgccaggctccgaggcgaaggggctgggagtggggtggcagttatagtggtatgatggaagtagtacaattactagtgacgagtacctccggtaggaacgggcccgtaagttccgtacccgtctacccgaaggtacgaaccgaactacccgaaagaaccacgtacctgtatcgtagactaaagtcgacccacgccgtagacgacgaccggacgacgacggacgttaacgtacgttacttacgttaggtacgacggacggaggtacgaacgtacggtcctaacg

SEQ ID NO: 265641 - DNA, 585 bp, Homo sapiens
  misc_feature: GYAE6OF02GWUD5.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtcgtggattccaccttcagtagtcatggcatgcacgtgggtcccgccgaggcctccgaggccgaaggggctgggaggtgggtggcagttatagtggtatggagtaggaagttagtacaagtacgtatgacagacgtccgtaggaacgggccgtacttccgaccgtcctaccgagacgaacaactacccgaaagaaccgacgctagtatcctagactaaagtcgaaccgacgaccgtagaacggacgaccggaggacgaccggtacgttaagtacgttaacgttacgtacggtagacggaagacggaacgacgacgccctaacgg

SEQ ID NO: 265642 - DNA, 610 bp, Homo sapiens
  misc_feature: GYAE6OF02GQ279.34.26.C04.1.454.CMB.1.raw
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgacgactctcctgtgcagcgtctggattcaccttnagtagtcagtggctatgctacgtcggggtccncgtaggcctaccgagggcgaaggggctgggacgtgggtgctaggttatgtggtatgtagtggtaatgtacaagttactagtgactaagtaccgttccggtaaggaaccgggtccttagttacccgacccgttcgtaccgaaggtacgacctaaccgtacccgaaagaccgaccgtacgtagtacgtccgtagacctaaagtcgaacctagccgtagacgacgaccggtaaggacctacggtcttaagtacgttacgttacgtacgtcggaacgtacggaaggacgacgacgacccgtaacg

SEQ ID NO: 265643 - DNA, 597 bp, Homo sapiens
  misc_feature: GYAE6OF02GIYT3.34.26.C04.1.454.CMB.1.raw
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtggggtccnccgaggcctaccgaggcgaaggggctgggaggttggggtgactagttanagttggtatgatggaaattagtacaattctangacagacgtcgaggtaacgggctattccaccgtntaccgagacgaaccaacttacccgaagaaccacgtctacggtacttcgacgaacgtaagtaccgaaccgtagtaccgtaggaacgaacggacccggaaggaccgaccggtacgttaacgttcgttaacgtttacgtggtacgacggaggtaacgacggtaccacggtccctaacgg

SEQ ID NO: 265644 - DNA, 559 bp, Homo sapiens
  misc_feature: GYAE6OF02GHSQC.34.26.C04.1.454.CMB.1.raw
  modified_base (344)..(344): a, c, t, g, unknown or other
  misc_feature (344)..(344): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggaccgtccctgagactctcctgtgcagcgtctggattcaccttcagtagtcatggcatgcacgtgggtccgccaggctccgaggcaaggggctgggagtggggtgcagttanagtggtatgagtggaagtagtacaaatactagtgacaagtaccgtccggtaggaacggggtccgtaagtttcccgaccggttcctacccgaagacgaaccaactacccaaagaacacgctagtactctagacaaagtcgaaccagcctaggacgacgaccgaaggacgacggctaatggttaacttacgtgtgacgagagagaccacgcctaacg

SEQ ID NO: 265645 - DNA, 567 bp, Homo sapiens
  misc_feature: GYAE6OF02IKI9X.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcacgtgggtccnccaggctccgaggcaaggggctgggagtgggtgctagttatagtggtatgatggaagtagtcaatactatgacagtactccgtaggaacgggccgtattccaccgtctaccgagacgacaactacccaaagaaccacgtctagactcgtagacaaactcgaaccacgcctaggaacgacgacccgagggaccacgggtactaagttcgttaacgtttaaccgtggtaggaccggtaaggacgaacgaccgtacgacccgtaacg

SEQ ID NO: 265646 - DNA, 558 bp, Homo sapiens
  misc_feature: GYAE6OF02HM57B.34.26.C04.1.454.CMB.1.raw
  modified_base (176)..(176): a, c, t, g, unknown or other
  misc_feature (176)..(176): n is a, c, g, or t
  modified_base (482)..(482): a, c, t, g, unknown or other
  misc_feature (482)..(482): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagnggtgtccagtgtcaggtgcagctggtggagtcgtgggggagcgtggcccagccctgggaccgtccctgacgactctcctgtgcagcgtctggattcaccttcagtagtcatggcatgccacgtgggtccgccaggcctccgaggcgagggggctgggacgtggggtgctagttatagtggtatgagtggaagtagtacaatacagtgacagacctcgtagaacgggcgtattccgaccgtctaccgagacgacaactacccaaagaaccgacgctagtaactcgtagacaaacgtcgacgaccccngtacgacgacgccgagacgacggacttaacgtgtaacttacgtgtacgtacgaggaacgacggaacacgacctacg

SEQ ID NO: 265647 - DNA, 574 bp, Homo sapiens
  misc_feature: GYAE6OF02G7HXT.34.26.C04.1.454.CMB.1.raw
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
tcagtacacgtgatcacgaccggtgctcgatttagtctagcgactttgggtttggggctgggagaggagcctagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagttagtcagtggcatgcacgtgggtcccnccgaggcctccgaggcgaaggggctggaggtgggngcagttangtggtatggatggaagtagtacaaatactatgcaagtaccgtccgtaggaacgggtccgtattccgacccgtctaccgagaacgaacctaactacccgaaaggaaccaccgcttacgtactcgtagacctaaagtcgaaccagtcccgtagacggaacgccggaaggaccgacggacgttagtacgttattacgtgtagacgaggagacgacgacgaccgtacg

SEQ ID NO: 265648 - DNA, 701 bp, Homo sapiens
  misc_feature: GYAE6OF02JR4Y0.34.26.C04.1.454.CMB.1.raw
  modified_base (262)..(262): a, c, t, g, unknown or other
  misc_feature (262)..(262): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggagggcgtggcccgagccgtggggaccgtccctgagctctcctgngcagcgtctaggtattccacccttcagtagtcagtggcattgcgaccgtcgggccgcccaggcggtaccccaggggctaaggggggcttggggaggtcggggtagggtacctaaggtttacgtaagttggggtaatggggaaattacggggaataaaggttctaaaataccgttactaggacccgtacggaccgtaccggtcgggaacgggtacccgtaacgttccgaacccgtccgtacccgaaggaaacgaccaaacgtacccaaacgaaccacgtaacgttgtaatacctaagaccgtaaacgtccgaacccgtaagacccgtaggaaacggaccggtaccgaccgggaaccgtaccgggtaccgttaattacggttaacgtttaccgtaggttaccggacggtaacggaacggacgaccgtacgacccgtaacgg

SEQ ID NO: 265649 - DNA, 520 bp, Homo sapiens
  misc_feature: GYAE6OF02GN8E3.34.26.C04.1.454.CMB.1.raw
  modified_base (342)..(342): a, c, t, g, unknown or other
  misc_feature (342)..(342): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcttcgttgctcttttaagaggtgtccagtgtcaggtgcagctggtggagtcgtgggggagcgtggcccagcctgggacgtccctgagactctcctgtgcagcgtctggattcaccttcagtagtcatggcatgcactgggtccgccaggcctccaggcaaggggctggagtggggtgcagttanagtggtatgagtggaagtgtacaatactatgcagactcgtagaacggcgattcaccgtcacagacacaactacccaagacacgctagtatctagacaagtcgaccagccgtagacgacgccgaggacgacggtactagttacgtattactggtagacgagagacgacgacgccctacg

SEQ ID NO: 265650 - DNA, 575 bp, Homo sapiens
  misc_feature: GYAE6OF02FN72J.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggacttccaccttcagtacgtcatggcatgcacgtgggtcccgccaggcctccgaggcgaaggggctgggagtggggtggctagttatagtggtatggatggaaagtagtacaattactatgacagactccggtaggaacgggccgtattccgacccgttcctaccgaaggacgaacaaacctacccgaaagaaccacgacgttgtaactctagaactaaagtcgaacccagcctaggacgacgaccgaggaccacggtctaagtcttaagttacgtgttgaccggagtacggacgaaccgagacccctacg

SEQ ID NO: 265651 - DNA, 542 bp, Homo sapiens
  misc_feature: GYAE6OF02IGZRR.34.26.C04.1.454.CMB.1.raw
  modified_base (241)..(241): a, c, t, g, unknown or other
  misc_feature (241)..(241): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactcccngagactctcctgtgcagcgtctggattcaccttcagtagtcatggcatgcacgtcgggtccgccaggcctccgaggcaaggggctgggagtggggtggcaggtttatagtggtatggatggaagtagtacaatactatgcagacctcgtggaacgggcattcgaccgtctaccagacgacaacgtacccaaagaaccacgtctagtactctagacaaagtcgaacccagcctaggaacgacgacccgaggaccgacggactaagtcgtaattacgtgtgacgagagacgacgacgcctacg

SEQ ID NO: 265652 - DNA, 645 bp, Homo sapiens
  misc_feature: GYAE6OF02JFUYL.34.26.C04.1.454.CMB.1.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtggcccagccgtgggactccctgacgactctcctgtgcagcgtctggattccaccttnagtagtcatggcatgcacgtgggtcccncaggcctccgaggcaaggggctgggagtggggtgcagttagagtggtaatgagtgggaacgtagtacaaagttactagtcgactagtaccgtaccggtaggaacgggtccgtaacttccgtacccgtcgtaccgaaggaacgaaccaaacgttccccgaaaagaaccgaaccgtctacggtaactaccgtagaaccgtaaagtccgaaacccgtacggtaccctaggaacggaaccggtaccggaacggaccgtaaccgggtacgttaacggttaacgttaagttaccgtacggttacggaccggtaaggaaggaccggtaaacgcgtacccgtaaccgg

SEQ ID NO: 265653 - DNA, 539 bp, Homo sapiens
  misc_feature: GYAE6OF02GRATJ.34.26.C04.1.454.CMB.1.raw
  modified_base (302)..(302): a, c, t, g, unknown or other
  misc_feature (302)..(302): n is a, c, g, or t
  modified_base (343)..(343): a, c, t, g, unknown or other
  misc_feature (343)..(343): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggctccgaggcgaaggggctggagtggggtgcagttangtggtatgatggaagtgtacaatactatgcagactccgtaggaacgggtccattcaccgtctaccagaacgacaactcccaaagaaccacgctagtactcagacaagtcgaccagcctagagacgaccgaggaccacggacgtaagtacgttaattaccgtaggttacgacgtaggagacgacacgaccctaacgg

SEQ ID NO: 265654 - DNA, 773 bp, Homo sapiens
  misc_feature: GYAE6OF02I6X6O.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacgtccctgacgactctcctgtgcagcgtctggattcaccttcagtagtcagtggcatcgcacgtcgggtcccgccgaggcctaccgagggccgaaagggggcctggggaggttgggggtggactaaggtttactaggtaggtataggagtgggaaacgtagttacaaattacgtaagttcggacgtaacggtaccgttacccgggttaacgggaaacggggtcccgttaagtttaccccgacccggtttacccgtaccccgtaagggaaccgaaaccgtaaacccgttaaccccgaaaacggtaaacccgtaaaccgtaccgttacggtaaccttccgttaaccggtaaccgtaaaacgttacccggaaacccgtaacggtaccccgttaaggaaaccggaaccgggaaccccggaaggggaacccgtaaccgggtacccgtttaaggttaaccgtttaaacgtttaccggttacggttaccggaacgggtaacggtaaacgggaacggtaaccggacccggtaccgtaaccccggg

SEQ ID NO: 265655 - DNA, 581 bp, Homo sapiens
  misc_feature: GYAE6OF02G1TZL.34.26.C04.1.454.CMB.1.raw
  modified_base (383)..(383): a, c, t, g, unknown or other
  misc_feature (383)..(383): n is a, c, g, or t
  modified_base (438)..(438): a, c, t, g, unknown or other
  misc_feature (438)..(438): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggaggcgtggcccagccgtgggaccgtccctgacgacctctcctgtgcagcgtctggattccacctttcagtagtcagtggcatgcacgtgggcccgcgaggcctcgaggcgaaggggctgggaggtggggtgctagtttatagtggtatgagtggaagttagtanaaatacgtatcgacaagtacctccggtaggaacgggccgtattccgaccgttccncgaagacaactaactacccgaaagaacgacgtactagtactctagaactaaagtccgaacctagacccgtagagaccgacgacggacacggtctaagttagttaacttacgtcggtagacgaggacgacgactacgccgtacg

SEQ ID NO: 265656 - DNA, 558 bp, Homo sapiens
  misc_feature: GYAE6OF02IOIGR.34.26.C04.1.454.CMB.1.raw
  modified_base (335)..(335): a, c, t, g, unknown or other
  misc_feature (335)..(335): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggacttcaccttcagtagtcatggcatgcacgtgggtccgcaggcctccgaggcaaggggctgggaggtgggngcagttatagtggtatgatggaagtagtacaatactagtgcagacgtcggtagaacgggccgattccaaccacctccgaagacgaaccaaccgaccaaacgaacctacaactactatctcgacaactacgaacacgacctaggaagacgtcgaacggacgaacggtcgtgttaactagttacgtgtagcgtaacgttacgtttaccctttagttcgtagtacg

SEQ ID NO: 265657 - DNA, 570 bp, Homo sapiens
  misc_feature: GYAE6OF02HWMJ6.34.26.C04.1.454.CMB.1.raw
  modified_base (498)..(498): a, c, t, g, unknown or other
  misc_feature (498)..(498): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgactctcctgtgcagcgtctggacttcacctttcagttagtcagtggcagtgccacgttcggggtcccgccgaggcctccgagggccgaaggggctgggagtggggtgctagttatagtggtatgagtggaagtagtacaattacgtagtcgactaacgtaccgtccggtagggaacgggtccgtactccgaccgtctaccgagacgaacaactacccaagaaccacgtctcgtaatctagactaacgcgaaccngccgtgacgacgcgacggacacggtcgtatacgtattacgtggtacgacggagacgacgacacgacctacgg

SEQ ID NO: 265658 - DNA, 563 bp, Homo sapiens
  misc_feature: GYAE6OF02GPTZN.34.26.C04.1.454.CMB.1.raw
  modified_base (308)..(308): a, c, t, g, unknown or other
  misc_feature (308)..(308): n is a, c, g, or t
  modified_base (343)..(343): a, c, t, g, unknown or other
  misc_feature (343)..(343): n is a, c, g, or t
  modified_base (385)..(385): a, c, t, g, unknown or other
  misc_feature (385)..(385): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggcctgggactccctgagactctcctgtgcagcgtctggtattcaccttcagtagtcagtggcatgctacgtcgggtcccnccaggtcctccgaggcaaggggctgggagtggggnggctagttatagtggtatggagtggaagtagtcaattactangcagtactcgtagaacggccgtatcgaccgtctacgagacgacaactaccaagacacgctagtactcgtagacaaacgtcgaaccgacgtccgtaggacgaacgaccgacggaccgacggtaccttaagtacgttaacttacgtgtagacggaggacggacgacgtaccgcctaacgg

SEQ ID NO: 265659 - DNA, 539 bp, Homo sapiens
  misc_feature: GYAE6OF02HM396.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtcccgccaggcctccgaggcgaaggggctgggaggtggggtggctaggttatagtggtatgatggaagtgtacaatactatgacagtactccgtaggaagggccgtattccgaccgtctaccgagacgacaactacccaaagaacacgctgtactctgacaatcgacacgcctaggacgacgaccgaggacgacggtactaagtagtattacgtgtagacgaggagagacacgcctacg

SEQ ID NO: 265660 - DNA, 590 bp, Homo sapiens
  misc_feature: GYAE6OF02G73MW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtcgggtccgccaggcctccgaggccgaagggggctagggaggtggggtggctagttatagtgggtatgagtaggaagtagtacaaatactatgacacgtactccggtaggaacgggtccgtagttccgacccgtcctaccaaggacgaaccaacttacccaaacgaaccaccgtctagtactcgtagaacctaaatcgaaccacgaccgtaggaacgaccgacggaacggaccgacggtacgtaagttagttaacttacgtaggtgacggaggaacgaggacgtacgccctaacgg

SEQ ID NO: 265661 - DNA, 636 bp, Homo sapiens
  misc_feature: GYAE6OF02HMB3P.34.26.C04.1.454.CMB.1.raw
  modified_base (339)..(339): a, c, t, g, unknown or other
  misc_feature (339)..(339): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggatttcaccttcagtatcatggcatgcacgtcgggtccgccaggcctccgaggcgaaggggctgggagtggggnggcgtagttatagtggtatgagttggaagttagtacaaagttactagtcgacgagtacgtccggtaggaacggggccgtagttccgacccgtcctaccgtaacggaacgaaccaaaccgttaccccgaaacgaaaccgaccgacgttacgtacgtaccgtagtaaccaaacgtacgaccgtacgacccgtaggacgaacggaccggacggaaccgacgggtacttaacgttagttaagttaccgttaggttacgacggtaagggaacggtaacggaacccgtacggacccctaaccg

SEQ ID NO: 265662 - DNA, 570 bp, Homo sapiens
  misc_feature: GYAE6OF02F25SA.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccctgggacgtccctgagactctcctgtagcaggcgtctggattcaccttcagttagtcatggctatgctacgtggggtcccaccaggcctccgaggcgtaagggggcctggggagtggggtgctagttatagtggtatggacttgggaaagtcgtacaagtactagtgacagactccggtaggaacgggccgtaattccgaccgtctccgaagtaacgacaactcccgaaagaccacggtctaggtaactcgtagaacaaagtcgaaccagcctagacgacgaccgtaggacacggctagtacgttacttacgtgtcgacgagtagacgacacgcctaacg

SEQ ID NO: 265663 - DNA, 705 bp, Homo sapiens
  misc_feature: GYAE6OF02H9GHL.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggttgagctgggttttcctcgttgctcttttaagaggtgtccagtgtcaggtgcagctggtggagtcgtgggggagcgtggcccagcctgggacgtcctgagactctcctgtgcaggctctggattcaccttcagtagtcatggcatggccacgttcggggtcccaccgaggcctccgaaggccgtaaagggggcctggggaggttggggcggctaaggtttatagttgggataggagtaggaagttagtactaaattacgtaatcggaccaagggtaccctaccgggttaggaaaccggggtcccgtaaagtttcccaacccgttctaccgaaggacgaaccgaaactacccgaaagtaaacccacggtaccttagtaacttccgtaagtaacccgtaaaagtaccgaacccgtaaaccggcccgttaacgaacgggtaaacgggaccccggaaagggtaaccccgacgggtaccttaaacgttcggtttaaaccgtttaaccgtgggttaccgacggtaaggacggtaaacggaaccgacgtacccgtaacgttaaccggg

SEQ ID NO: 265664 - DNA, 604 bp, Homo sapiens
  misc_feature: GYAE6OF02GK0GM.34.26.C04.1.454.CMB.1.raw
  modified_base (590)..(590): a, c, t, g, unknown or other
  misc_feature (590)..(590): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtggagtctgggggaggcgtggcccagcctgggacgtccctgagactctcctgtgcagcgtctggattcacctttcagtagtcatggcatgcacgtcggggtccgccaggcctccgaggcgaaaggggctagggagtggggtggcagtttatagtggtatgagtggaaacgtagtacgtaaatctatcggacaaggtaccgtcccggtaggaacgggtccgtagttacccgacccgttctacccgaaggacgtaacctaaacgtacccgaaacgtaaccaccggcttacgtactacgtgaacctaaagtcgaacccaggacctaggacgaacgccggagtaccgacgtactacgtaggttaactacgtggtacgacgaaggtcggaanacgacgacctaacg

SEQ ID NO: 265665 - DNA, 556 bp, Homo sapiens
  misc_feature: GYAE6OF02FLI5Q.34.26.C04.1.454.CMB.1.raw
  modified_base (349)..(349): a, c, t, g, unknown or other
  misc_feature (349)..(349): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcactgggtcccgccaggcctccgaggcgaaggggctgggagtggggtggcagttanagtggtatgatggaagtagtacaatactatgacagactcgagagggcatcaccgtctaccagagacaactacccaaagaaccacgctagtatctacgacaaatcgaaccacgcctaggaacgacgaccggacggacgaccgggtactaacgttagttaactttaccgtggtacggacggaaggaaggaacgaccgacgaccctaacg

SEQ ID NO: 265666 - DNA, 966 bp, Homo sapiens
  misc_feature: GYAE6OF02H0Y0Q.34.26.C04.1.454.CMB.1.raw
  modified_base (109)..(109): a, c, t, g, unknown or other
  misc_feature (109)..(109): n is a, c, g, or t
  modified_base (255)..(255): a, c, t, g, unknown or other
  misc_feature (255)..(255): n is a, c, g, or t
  modified_base (334)..(334): a, c, t, g, unknown or other
  misc_feature (334)..(334): n is a, c, g, or t
tcagtacacgtgatcacgaccggtgctcgatttagtctagcgactttgggtttggggctgggagaggagcccagcactagaggtcggcggtgtttccattcggtaatcngcactagaacaaccagaaggacgtccaccactggaggtttgggtcgtgtaggcgttcggttttcgttccgttgtcgttacttttaagtaaggtggtcctacgtggtgacggtggcacgcgtgggtgggtaggttcggtttaggggnggggacggtccggtcccgaccggtccggtccggggtaccggtccccgtacgaggtaacctcccttccgtcggtggaccncggccggttctcggtacgtttacctacccttaccgttaaggagttccgagttacggcgtaacttacggtccgaacccggtttcgggggttaccccgggaccccgacgggttacccggtacccgtaaccggggaacggggtaaaccggggggtacggttacggggtagggggttcggggggtcgttaccgggttaaagtttaaaggtttagtacggggtttaggttaagaacgggttaagggtaaagttacggttaaactaaaacttaagttacgtacgtacggaaccgtttaaccgtaccgggtaagggaacggggtacccggtacgtttaccctaccggttccccgtaccggaaagaaacggaaccgtaaaaccgtaaacccctaaaccgggaaactaccggttaccgttagttaaccgtacgttaaacggaacccgtaaaacgttaacccggaaacccgtacggaaccgtaccgggtaagggaaacccggtaaacccggaacccggggtaacgtaacccgggttaaccgtcgttaaaaggtttaccggttaacggtttacggaacgggaacggaaccgggtaacggtaaacccgaaacggtaaccccgttacgaaccccgttaacggggg

SEQ ID NO: 265667 - DNA, 588 bp, Homo sapiens
  misc_feature: GYAE6OF02JYE70.34.26.C04.1.454.CMB.1.raw
  modified_base (283)..(283): a, c, t, g, unknown or other
  misc_feature (283)..(283): n is a, c, g, or t
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
  modified_base (548)..(548): a, c, t, g, unknown or other
  misc_feature (548)..(548): n is a, c, g, or t
tcagtacacgtgatcacgaccggtgctcgatttagtctagcgactttgggtttggggtcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggcccagcctgggaccgtccctgacgactctcctgtgacagcgtctaggattcaccttnagtcgtcagtggcatgcacggtggtcccncctaggcctccgaggcaaggggcngggagtggggtcgctagttatntggtatgacgttggaagtacgctaatacttagngcagacgttccgagaacggccgtntaccgacgtctacgagtacgaacactcccgaaagaccacggtatgtactagtcgaaccaaagtccgaacgacggtacctaggaaacgacggaccggaacgacctcgggtaaccttggtaagttccgttaacgnggtaccgacgtaacggagaacgtaccacgtaccctaacgg

SEQ ID NO: 265668 - DNA, 578 bp, Homo sapiens
  misc_feature: GYAE6OF02J1GHX.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggaccgtccctgagactctcctgtgcagcgtctggattcaccttcagtagtcatggcatgcactgggtccncaggcctccgaggccaaggggctgggagtggggtgctaggttatagtggtatggatggaagtagtacaattactagtgacagtaccgtacgtaggaacgggtccgacttccgaccgttctaccgagagacactacccgaagaacacgctagtactacgtgacgaaagtcgaaccctagacccgtaggacggacgtaccggaggaccgacgggtactaagttggtaacttacgtacggtacgacggtaggacggaagaccgaggcccgtaacgg

SEQ ID NO: 265669 - DNA, 564 bp, Homo sapiens
  misc_feature: GYAE6OF02I2NX5.34.26.C04.1.454.CMB.1.raw
  modified_base (356)..(356): a, c, t, g, unknown or other
  misc_feature (356)..(356): n is a, c, g, or t
  modified_base (382)..(382): a, c, t, g, unknown or other
  misc_feature (382)..(382): n is a, c, g, or t
  modified_base (463)..(463): a, c, t, g, unknown or other
  misc_feature (463)..(463): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctggacgactctcctgtgcagcgtctggattcaccttcagtagtcatggcatgcacgtggggtccgccgaggcctccgaggcgaaaggggcctgggaggtggggtggcaggtttanagtgggtatgaagtgggaattacgtnaatactatgcaagctcgtagaacggcgtatcaccgtctaccgaagacgaacaacgtaccaaagaccacgctagtactcganactaacgtcgaaccagcctagacgaacgccgaaggaccacggacgttaactcgttaattacgtcggtagacggagaacggacgaacgacggtccctaacgg

SEQ ID NO: 265670 - DNA, 643 bp, Homo sapiens
  misc_feature: GYAE6OF02GJP7U.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtgggtcccgccgaggcctccgaggcgaaagggggctgggagtggggtggctagttatagtggtatggatgggaatagtacaatactatgacagtaccgtccggtaggaacgggtccgtattccgacccgttcctacccgaaggaacgaacccaaactaccccgaaagaaacccgaccgaccttagtacttacgtacgaacctaaagtcgaacccgtacggtacccgtaggaacggtacggacccggaacgggaccgtaaccgggtacgttaacgttacggttaacgtttaaccggtaggttacggtaacggaacggtaaggaacgaaccgtacggtacccgtaaccg

SEQ ID NO: 265671 - DNA, 660 bp, Homo sapiens
  misc_feature: GYAE6OF02F9K3F.34.26.C04.1.454.CMB.1.raw
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttggggttttcctcgttgcttctttttaagaggtgtccagtgtcaggtgcagctggtggagtcgtgggggaggcgtggcccagcctgggacctcccnganctctcctgtgcagcgtctggattccaccttcagttagtcatggcagtgctacgtcgggtcccgccgaggcctccgaggcgaaggggctgggtaggtggggtggctagttagtagtgggtatggaagtaggaagtagtactaaatactatgacagtacgtcgtaggtacggcgtactaccgtaccgtcctacgaggaagaccaacgtacccgaaagtaccgacgtcgttagtacttacgtacgaactaaacgtaccgaaccgacggtaccgtacggaaacggaccgggtaaccggaacgggtaccgtaaaccgggtacgtaaccggtttacgtttaaccggtttaacgttacgggtacggaccgggtaacgggtaaacggaaccggtaaccgtaccggtaccccgtaacgg

SEQ ID NO: 265672 - DNA, 576 bp, Homo sapiens
  misc_feature: GYAE6OF02IIJUC.34.26.C04.1.454.CMB.1.raw
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
  modified_base (363)..(363): a, c, t, g, unknown or other
  misc_feature (363)..(363): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccatggagtttgggctgagctgggtttttcctcgttgcttcgtttttaagaggttgtccagtgtcaggtgcagctggtggagtcgtgggggagcgtggcccaggcctgggactccctgacgactctcctgtgcagcgtctggattcaccttcagtagtcatggcatgcacgtgggtccnccaggcctccgaggcgaaggggctgggagttggggngctagttatagtggtangagtggaagtagtcaaattactagtcgactagaccttccggtaggaacgggccgtattccgtaccgtctaccgagacgaacaactacccgaaagaacacgtctacgtatcgtagaacaagtcaaccgtagcctagacgacgcggacgaccgacggtacttaagtgttacgttaacgtggtagacgacggaacgaagaaccgacgacctaacgg

SEQ ID NO: 265673 - DNA, 654 bp, Homo sapiens
  misc_feature: GYAE6OF02HX2J6.34.26.C04.1.454.CMB.1.raw
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggacttcaccttcagttagtcagtggacagtcgcacgtcggggtcccnccgagggcctccgagggacgaaggggtctgggaggtggggtgctaaggtttanagttggtatgagtaggaaagtagtactaaattacgtagtgacgtaacggtaccgttaccggtacggaaacgggtccgtaattacccggtaccgttcctacccggaagaccgaacctaacctacccgaaaacgaaccgaccgtcttacgtacgtactacgaacctaaacgtaccgaacccgtacgtaccgtaggaacgaccgaccggaccggacgtaaccggtacgttaagtacgttaacgttacgtacggtagacggtaagaacggacgtaacgacgtacccgtacgg

SEQ ID NO: 265674 - DNA, 647 bp, Homo sapiens
  misc_feature: GYAE6OF02I0MWV.34.26.C04.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctggagctctcctgtgcagcgtctggacttcaccttnagtagtcagtggcatgcacgtgggtccnccaggcctccgaggcgaaggggctggaggtggggtgctagttatagtggtatgagtaggaagtacgtacaatacgtatgacaagtaccgtccggtaggaacgggtccgtaagtttccgaccgttctaccgaaggaacgaacctaaaccttacccgaaacgtaaccgacccgtacgttacgtactaccgtagaacctaaacgtccgaacccgtacgtacccgttaggaaccggtacgacccggtaagggaacccgacggtaccgtaagtttaacggttacgttaccgttaggttacggacggtaacggtaacggtaacgaaccgtacggacccgtaaccgg

SEQ ID NO: 265675 - DNA, 580 bp, Homo sapiens
  misc_feature: GYAE6OF02H6UWJ.34.26.C04.1.454.CMB.1.raw
  modified_base (306)..(306): a, c, t, g, unknown or other
  misc_feature (306)..(306): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctggggacgtccctgagactctcctgtgcagcgtctggattcaccttcagtagtcatggcatgccacgtggggtccnccaggcctccgagggcgaagggggctgggaggttggggnggctaggttatagttggtatggagttagggaaagttagtacaaattaccttagtcgactaagtaccgtccggtaggaacggggtcccgtaacttccgaacccgttctaccggagaacgaacctaaactacccaaagaaccacgtcgtgtaactcagacaatcgaccagcctgagacgcgaagacgacggtctagtgttacttacgtgtagacgagacgtacgacacgtacctacg

SEQ ID NO: 265676 - DNA, 497 bp, Homo sapiens
  misc_feature: GYAE6OF02IISHW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtccgccaggctccgaggcaaggggctgggagtggggtggcagttatatggtatgatggaagtagtcaatactatgcagactcgtgaggcgatcacgtctcagacgacactccaagacacgctgtactctgacaagtcgaccagcctgagacgcgaggacgacggactatagtattacgtgtgcgagagagacacgctacg

SEQ ID NO: 265677 - DNA, 536 bp, Homo sapiens
  misc_feature: GYAE6OF02GD9JD.34.26.C04.1.454.CMB.1.raw
  modified_base (305)..(305): a, c, t, g, unknown or other
  misc_feature (305)..(305): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattccaccttcagtgtcatggcatgcacgtgggtccnccaggcctccgaggcaaggggctgggagtggggtgctagttangtggtatgatggaagtgtacaatactatgacagactcgtagacggccgtatcaccgtctcagacgactaactaccaagacaccgtctagtactctcgacaacgtcgaccgagccgtagacggacgaccgacggacacggacttaacgtagttacgttacgtgtgacggagacgaggacacgctaccgg

SEQ ID NO: 265678 - DNA, 596 bp, Homo sapiens
  misc_feature: GYAE6OF02IPFID.34.26.C04.1.454.CMB.1.raw
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggaccgtcctgagactctcctgtgcagcgtcgtggacttcaccttnagtagtcagtggcatggccacgtgggtccccnccgaggcctaccgaaggccgaaggggctaggggacggtggggtcgactagttatgtaggtatgaagttggaaagtagtacaatacagtcgacacgtacgtccggtaggaacggccgtattaccgaccgtctaccgaagacgaacaacgtaccaaagaccacgactagtactacacggaactaaacgagaacccagaccgtgaacggaccgaccgaaggaccgacggtactaagttactacgttacgtagtagacggaaggtaagaacgacacggacctaacgg

SEQ ID NO: 265679 - DNA, 656 bp, Homo sapiens
  misc_feature: GYAE6OF02H94XO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggactccctgagactctcctgtgcagcgtctggacttcacctttcagtagtcatggcatgcacgtgggtcccgccgaggcctccgagggcgaaagggggctgggaggttggggtggctaggtttaatagtgggttatggatgggaagtagtacaaagttactatggcaacgtaccgttcggtagggaacgggtcccgtacttaccgtacccgttcgtacccgaagaacgaacctaaaccgttaaccccgaaagtaaaccaccgtcgttacgtataccgtagaaccgaaactacgtaacccacgtcccgtaaggacggtaaccggaccggaacggaacccgacggtacgttaagttacggttaacgtttaacgttggttaccggacgggtaagacggaacggaccgtaccggaccctaaccggg

SEQ ID NO: 265680 - DNA, 555 bp, Homo sapiens
  misc_feature: GYAE6OF02GERGP.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtccnccaggcctccgaggcaaggggctgggagtggggtgctagttatagtggtatgataggaagtagtacaatactagtgcagtactccggtaggaacgggccgtattccgaccgtctaccgagacgacaactacccaagaaccacgctagtactctagactaaagtcgaaccacgcctaggacgacgaccggacggacgaaccggcttaagtacgttacttacgtggtacgacgaggagagaccgagccctaacg

SEQ ID NO: 265681 - DNA, 576 bp, Homo sapiens
  misc_feature: GYAE6OF02GKYBV.34.26.C04.1.454.CMB.1.raw
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (544)..(544): a, c, t, g, unknown or other
  misc_feature (544)..(544): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttttggctgagctgggttttcctcgttgcttcttttaagaggtgtccagtgtcaggtgcagctgggtggagtcgtgggggagcgtggcccagcctgggacctccctgacgacttctcctgtgcagcgtctggattcaccttnagtagtcatggcatgcacgtgggtccnccgaggcctaccgaggccaaggggctgggagtgggngctagttanagtggtatggatggaagtagtacaaatactagtgacagtacctcggtaggaacgggcctaattccgaaccgttctaccgagaacgaaccaacgtacccaaagaaccgacgtctagtactcgtagaacctaaatcgaaccagacctaggacgacgaccggaggaccgacggtactaagttacgttacttacgnggtacgacggaggtacgagacgacgcctaacg

SEQ ID NO: 265682 - DNA, 563 bp, Homo sapiens
  misc_feature: GYAE6OF02H8LEH.34.26.C04.1.454.CMB.1.raw
  modified_base (176)..(176): a, c, t, g, unknown or other
  misc_feature (176)..(176): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagnggtgtccagtgtcaggtgcagctggtggagtcgtgggggagcgtggcccagccgtgggacgtccctgagactctcctgtgcagcgtctggattcaccttcagtagtcatggcatgcacgtgggtcccgccaggcctccagggcgaagggggctgggaggtggggtggctagttatagttggtatgagtaggaagtaggtcaaaattactagtcgactacggtacctaccggtaggaacggggtccgtattccgaccgttcgtacccgaagacgaacaactacccgaaagaacaccgtctagtactcgtagacaagtcgaaccgagtcctagacgacgaccgagacgacggctagtgttatcgtgtgacgacgagacgacacgctacg

SEQ ID NO: 265683 - DNA, 618 bp, Homo sapiens
  misc_feature: GYAE6OF02G4TNJ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggcccagccgtggggacctccctgacgactctcctggtgcccaggcgtcgtggattccaccttcagtagtcatggcagtgctacgtcggggtccgccagggcctccgaggcgaaggggctgggagttggggtgacgtaggttatagtggtataggagttagggaaagttagtactaaattacgtagtgacgtaacgtccgtaccgtaggtaacgggccgtacttcccgaccgtcctaccgaagaacgaaccaacgttaacccgaaagtaaccgaccgtctagtactcgtagaacctaagtaccgaaccgagtcccgtaagacggtaacgaccgggaagacgaccgtacgttagttacgttattacgtgtagacgagacgacgacgacgcctacg

SEQ ID NO: 265684 - DNA, 563 bp, Homo sapiens
  misc_feature: GYAE6OF02GUT3V.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtcccgccaggcctccgaggcgaaggggctgggaggtggggtggcaggttatagtgggtatggagtgggaagtagtacaaattactagtgctagacctccggtaggaacgggccgtattccgaccgttctaccgagacgaccaactacccaaagaaccacgactagtatcgtagacaaagtcgaaccagcctaggacgacggaccgaggaccacggtctaagtacgttaattacgtggtagacgtaggacgaggacacgacctacg

SEQ ID NO: 265685 - DNA, 578 bp, Homo sapiens
  misc_feature: GYAE6OF02FG8IP.34.26.C04.1.454.CMB.1.raw
  modified_base (279)..(279): a, c, t, g, unknown or other
  misc_feature (279)..(279): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggccccagccgtgggacgtccctagagactctcctggtgcagcgtctggattcaccttnagtagtcatggcatgcacgtgggtccgccaggctccgaggcaaggggctgggagtgggtgctagttatagtggtatgtatagggaagtagtacaaattactagtgacagaccgtccggtaggaacgggtccgattccgaccgtcctaccgaacggaacgaaccgtaactacccgaaagaaccaccgactacgtaactctagacaaagtcgaaccagcctagacgacgaccggacggaccacggtacttaagtagttaacttacgtgtacgaggacgaacgacgaacgacggacctaacg

SEQ ID NO: 265686 - DNA, 585 bp, Homo sapiens
  misc_feature: GYAE6OF02G4C12.34.26.C04.1.454.CMB.1.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgtgctcttttaagaggtgtccagtgtcaggtgcagctggtggagtcgtgggggagcgtggcccagccgtgggacgtccctgagactctcctgtgcagcgtctggacttcaccttcagtagtcatggcagtgcacgtggggtcccnccgaggcctccgagggcgaagggggtctgggaggtggggtggactaggtttatagtggttanggagtgggaaagtcgtacaaattactatggacagtaccgtccggtaggaacgggccgtattccgaccgttcctaccgagacgtaaccaacctacccgaaacgaaaccgaccgtacgtacgtactctacgacaaacgtacgaaccacgtccctagacgacgaccgagacgacggcgtatagttacttacgtgtacgacgagagagacagacctacg

SEQ ID NO: 265687 - DNA, 528 bp, Homo sapiens
  misc_feature: GYAE6OF02JBRFQ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtgggtccgccaggctccaggcaaggggctgggaggtggggtggcaggttatagtggtatgatgggaagtagtacaattactagtgacagactaccggtggaacgggccgtacgttcgtaccgtctaccagacgacaactacccaagaacaacgctagtatcgtgacaatcgaaccagctgagacgccgagaccgacgtctagtgtatacgtgtgcgagagagacgacgcaacg

SEQ ID NO: 265688 - DNA, 605 bp, Homo sapiens
  misc_feature: GYAE6OF02HC4XF.34.26.C04.1.454.CMB.1.raw
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgagactctcctgtgcagcgtctggattcaccttcagtagtcatggcatgcacgtgggtcccnccaggcctccgaggcgaaggggctgggagtggggtcggctaggtttatagttggtatggagtgggaaagttagtacgaaattacgtaagtcgactaagaccgttccggtaggaacggggtcccgtaacgtttaccgacccggttcctacccgaaggaacgaaccaaacttaccccgaaacgaaccaaccgtactagtacgtctaggactaaagtcgaaccaggtccctaggacgacggacccgaaggaccgacggacttaagtcgttaattaccgtggtagcgaggagacgacagcctacg

SEQ ID NO: 265689 - DNA, 727 bp, Homo sapiens
  misc_feature: GYAE6OF02F7NVO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggttttcctcgttgcttcttttaagaggtgtccagtgtcaggtgcagcgtggtggagtcgtggggggagcggtggcccaggccgtgggaccgtccctggacgtacctcctcctgtgcagcgtctgggattcaccctttcaaggttacgtccagttggccaattcggaccaccgttcgggggtcccgtacccgagggtccctacccgaaggggaccgaaacggggggccttggggaggttgggggtcggacgtaggtttaatagttggggtaattggaagtttgggaaagttacggtaactaaagttacgtatcgactagtacccgttcggtaggaacggggtccgtaagtttccgacccgttactacccgtaaggaacgtaccaaaccgttacccgaaagtaaccaacgtactaggttaactctaggaacctaaagtcggaacccacggtacccgtaaggaacggacggtacccggaacgggaccgaacccggtacttaacgttacgttaacgtttaacggttggtaggtaccgggaaggaccggtaacgaaccggtacggtaccctaaccgg

SEQ ID NO: 265690 - DNA, 567 bp, Homo sapiens
  misc_feature: GYAE6OF02GET0W.34.26.C04.1.454.CMB.1.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtncagctggtgagtcgtgggggagcgtggcccagcctgggacctccctgagactctcctgtgcagcgtctggatttcacctttcagtagtcatggcatcgcacgtgggtccnccaggcctccgaggcaaggggctggagtgggtgctagttatagtggtatgagtggaagtagtacaatacgtatgacaagacctccggtaggaacggccgtagttccaccgtctaccgaggacacctaacgtacccgaaagaaccgacgtactacgtactaccgtagaactaaatcgaaccacgtcctagaagacgaccgaggaccacggtactagttacgtacttacgtagtgacgtaaggagacgacgacgacctaacg

SEQ ID NO: 265691 - DNA, 634 bp, Homo sapiens
  misc_feature: GYAE6OF02FFPZL.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccaggcctgggaccgtccctgagacctctccgtgtgcagccgtctggacttccaaccttcagtagtcagtggccatcgccacgtcgggtccccgccgaggtcctcccgaagggccgaaaggggggtccttggggaacggttgggggtacgcgtaaggtttagtagttgggtatggaacgtagggaaagttgtacaaagttactagtcgacagaccgtccggtggaaacgggcctattcccgaccgttcctaccgaaggacgactaaccgtaacccaaagaccacgcttgtactcgtagaactaagtccgaaccagaccgtagaacggacgacccggaaggtaccgaccggcttaagtcggttaacttaccgtgtacgacgaaggaccgagacccgtacggaccctaacg

SEQ ID NO: 265692 - DNA, 631 bp, Homo sapiens
  misc_feature: GYAE6OF02HXS1K.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccaggcctgggaccgtccctgacgactctcctgtgcagcgtctggacttcaccttcagttagtcatggctagtgcacgtcggggtcccgccgaggcctaccgaggaccgaagggggctagggaggtggggtagctagtttagtagttaggtatggagtagggaagttagtacaaagttactagtcgacaagtaccgttcggtaggaaacggggtccgtaactacccgtaccgtccgtaccgaaggaacgaactaacctacccgaaagaacctaccgtcttagtaacttcgtacgaacctaaagtcgaacctacgtccgtaggaacgacggaccggacggacgaccggtactagtacgttaattacgtagtacggacgtacggaacgacgaacgacgtaccgtaacg

SEQ ID NO: 265693 - DNA, 634 bp, Homo sapiens
  misc_feature: GYAE6OF02JAZNR.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgacgactctccgtgtgcagcgtctggacttcaccttcagtagtcatggcatgcacgtgggtccgccaggcctcagggccgaaggggctggggagtgggggtggactaggtttatagtggttatggactagggaagttagtactaattactatgactaagacctccggtagaacgggtccgagtttccgacccgttcgtccaaggtaacgaacctaacgtacccgaaagaacccgtaacgtccgttagtacttaccgtagaaccaaagtacgaaccgacgcccgttaggaagaccgaccgggtaacggaccaacgggtacgttaagtttacgtacggtttaacgtcgttacggacggtaacggacggaagaaccggaccgaccctaaccgg

SEQ ID NO: 265694 - DNA, 527 bp, Homo sapiens
  misc_feature: GYAE6OF02FOX55.34.26.C04.1.454.CMB.1.raw
  modified_base (469)..(469): a, c, t, g, unknown or other
  misc_feature (469)..(469): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcacgtgggtcccgccaggcctccgagggccaagggggctgggaggttggggtgcagttatagtgggtatgatggaagtagtacaatactatgcagactcgtagaggcatcacgtcaccgagacacaactacccaagaaccacgctagtactcgtagacaatcgaaccagcctgacgngaccgaggacacgtctagtgttaattacgtgtcgacgaggagacgacgacgcctaacg

SEQ ID NO: 265695 - DNA, 686 bp, Homo sapiens
  misc_feature: GYAE6OF02HFVFI.34.26.C04.1.454.CMB.1.raw
  modified_base (178)..(178): a, c, t, g, unknown or other
  misc_feature (178)..(178): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
tcagtacacgtgatcacgaccggtgctcgatttagtctagcgactttgggtttggggtcgtgggaggaggagcccagcactagaggtcggcggtgtttccattcggtgatcagcactgaacacagaggactcaccatggagtttgggctgagctgggtttcctcgttgctctttaagnggtgtccagtgtcaggtgcagctggtggagtcgtggggggaggcgtgggaccccaggcccgtggggaccttcccgtgacgaccttctccttgtgcaggcgtctggacttcacctttcgagtagtcagttggcagtgctacgtcggggtcccnccagggcctccgnggaccgaaggggcgtggacggttggggtggcttagttaatggtaggtattcggaagttgggaaaacttggtacaaaacgtttatacgtcgacaacggtaccctaccggtaggaaccggggtacccggtaagtttacccgacccggtcttaccgaacggtacaaaccgaaactaccccgaaagaaacccgaaccgtctaaccggttataccgtacgaacctaaacgtcgaaacccgtcgacccgtaggaaacgacggacccgaaggtaccgtaccgggtacttgtaggtttacgttacgttcggtaggtacgaacggaggtaacggaccgtacgacctaaccgg

SEQ ID NO: 265696 - DNA, 583 bp, Homo sapiens
  misc_feature: GYAE6OF02GPCG2.34.26.C04.1.454.CMB.1.raw
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacctccctgagactctcctgtgcagcgtctggattccaccttcagtagtcatggcatgcacgtgggtccnccgaggcctccgaggccgaaggggctgggagtgggngcagttanagtggtatgatggaagtgtacaattactatgacaagtacctcgaggacgggcctatccacgtctaccgagacgacaactacccaagaacacgtctagtactcgtacgaacaaagtcgaaccacgtaccgtaggacgaccgaccggtaacggaccgacgggtacctaaggttaccgttaacttacggttacgtggaaccggtaaggtaacggacggaaccgtaccgaccctaacgg

SEQ ID NO: 265697 - DNA, 898 bp, Homo sapiens
  misc_feature: GYAE6OF02ILC4V.34.26.C04.1.454.CMB.1.raw
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (252)..(252): a, c, t, g, unknown or other
  misc_feature (252)..(252): n is a, c, g, or t
  modified_base (459)..(459): a, c, t, g, unknown or other
  misc_feature (459)..(459): n is a, c, g, or t
tcagtacacgtgatcacgaccggtgctcgatttagtctagcgactttggggtttgggggctgggagaggagcccagcgactagaggtcggcggtgtttccattcggtcgatcagccactgaacacagaggactcacatggagtttggctgagctggtttcctcgttgctctttaagngtgtccagtgtcaggtncagctggtggagtcgtgggggagcgtggccagccgtgggacctccctgacgaccttcncctgtagaccgagccgtctagggtacttcgtacccttgaaggttagtacaagttcgggacctaagttcggaccgaccggtttcggggggtaccccgcccgaacggggtcccgtaccggaaggtaccggtaaacgggggtccgtaggggtaaccgggtttcgggggacggtccgttaaaggtttaacgttaaggtacggggttttaanacggggtaaagttaacggggttaaagttaacggttacgtaaaacgtttaacggttaacgtcggaaaccgtaacggaccggtttaccgggtaacggggtaaaccggggtacccgttaacgtttacccggttaacccggttacttaccccggaaaggtaacccgtaaaccgtaaccgttaaccccgaaaagtaacccgtaccggttaacgttacgttaacgttaccgggtacggtaaacgtaaaccggttaaccggaacccgttaacgggtacccgtaacggggaaaccgtaccggggtaaacccgacggggttaaccgaaccgggtaaccgttttaacggttacccggttaaccgttttaacccggtacggtttaacggtacccggtaacgggttaaccggtaaaccgacccggttaacccggtaccccgttaaaccggg

SEQ ID NO: 265698 - DNA, 679 bp, Homo sapiens
  misc_feature: GYAE6OF02JMOIF.34.26.C04.1.454.CMB.1.raw
  modified_base (354)..(354): a, c, t, g, unknown or other
  misc_feature (354)..(354): n is a, c, g, or t
tcagtacacgtgatcacgaccggtgctcgatttagtctagcgactttgggtttggggtcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtaggagtcgtggggggagcgtggcccaggcctggggactccctgagactctcctgtgcagcgtcgtggtattcctaccttccagtacgtcagtggcagtgcacgttcgggtccgccaggcctccgaggcgaaggggctagggagtggggnggtcaggttataggtaggtatggagtagggtaaagtaggttacaaagttacctaagtcgaccgaaggtaccgtacccggtaggaaaccggggtaccgtaacgtttacccgtacccgttcctaccgtaaggaacgtaaccgtaaaccttacccgaaaacgaaacctaaccgaaactttaacgtacttacgtacgaacctaaagtacgtaaactacgttcgtaacggaaggtaaccggacggaaggacccgtacgggcttacggttacctttaagtacgttacgtacgacgttaaggggacggtttaacgggctaacgtattaccgg

SEQ ID NO: 265699 - DNA, 520 bp, Homo sapiens
  misc_feature: GYAE6OF02IBRZ0.34.26.C04.1.454.CMB.1.raw
  modified_base (465)..(465): a, c, t, g, unknown or other
  misc_feature (465)..(465): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtctggggggagcgtggcccagcctgggaccgtccctgagactctcctgtgcagcgtctggattcaccttcagtagtcatggcatgcactgggtccgccaggctccgaggcaaggggctgggagtggggtgcagttatagtggtatgatggaagtagtcaaatactagtgacagactcggtagaacgggccgtattcaccgtctaccagagacaactacccaagaacacgctgtatctagacaatcgaaccagcctgagngactgacggacgacggctagtgtaacttacgtgtgacggagagagaccgagaccc

SEQ ID NO: 265700 - DNA, 620 bp, Homo sapiens
  misc_feature: GYAE6OF02JP5A4.34.26.C04.1.454.CMB.1.raw
  modified_base (177)..(177): a, c, t, g, unknown or other
  misc_feature (177)..(177): n is a, c, g, or t
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtgagtcgtgggggagcgtggcccagccgtgggacctccctgagactctcctgtncagcgtctggattcaccttcagtagtcatggcatgcacgtgggtcccnccaggcctccgaagggcaaagggggcctgggacgtggggtaggctaaggttatagtgggtatggatacgggaagtagtaccaatactagtcgacgtacgtacgttccggtaggaacgggtcctacttccgaaccggttctaccgaggtaacgaccaacgtacccaaagaaccgtacgaccttagtactcgtacggactaaacgtaccgacctacgccgtacggaagtacggacccggtaaggacgtaccggtctaacgtagttaccgttacgtacggtgtaaccggaagacggaagtaacccaggtaccctaccgg

SEQ ID NO: 265701 - DNA, 550 bp, Homo sapiens
  misc_feature: GYAE6OF02JMWAD.34.26.C04.1.454.CMB.1.raw
  modified_base (194)..(194): a, c, t, g, unknown or other
  misc_feature (194)..(194): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagaggtgtccagtgtcaggtncagctggtggagtctgggggagcgtggcccaggcctgggacctcctgagctctcctgtgcagcgtctggattcaccttnagtagtcagtggcatgctacgtgggtccnccaggcctccaggcaagggctggagtgggtgctagtatgtggtatgatggaagtgtactaatactatgcagacctcgtagaaggccgtatcgaccgtncgagagacaatacccaagacacgtcctgactcgacgtacaaatcgaacctcgaccgtggacgtacggaccgaagggtaccacgggtacctaagggttcttaacggttaaccttggcggtacagggaagtacgacgtaccgtacctaaccg

SEQ ID NO: 265702 - DNA, 567 bp, Homo sapiens
  misc_feature: GYAE6OF02FY1CC.34.26.C04.1.454.CMB.1.raw
tcagtacacgtgatcacgaccggtgctcgatttagtctagcgactttgggtttggggctgggagaggagcccagcactagaggtcggcggtgttcccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtcccgccaggctccaggcaaggggctgggagtgggtgcagttatagtggtatgagtggaagtagtacaatacgtatggcaagtacgtccgtaggaacgggaccgtacgttaccgaccgttccgtaccgacgacgacctaactacccgaacgaaccaccgactagtactctcgactaatacgaccacgccgtagacgacgaccgaggaccgacggacgttaacgtagttaacgttaccgtagtcgacggacggagaggacacgcctaccg

SEQ ID NO: 265703 - DNA, 510 bp, Homo sapiens
  misc_feature: GYAE6OF02HWE8X.34.26.C04.1.454.CMB.1.raw
  modified_base (301)..(301): a, c, t, g, unknown or other
  misc_feature (301)..(301): n is a, c, g, or t
  modified_base (334)..(334): a, c, t, g, unknown or other
  misc_feature (334)..(334): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcacgtgggtccnccgaggctcgaggcgaaggggctggagtggggngctagttatgtggtatgagtggaatgtcaatctatgcagctcgngaggcatcncgtcncagagacactccaagacacgctgtactctagacaagtcgaccacgtactgacgacgccgaggaaaccgcggactacgttagtacttacgtgtcgacgagtaggacgacgacgcctacg

SEQ ID NO: 265704 - DNA, 567 bp, Homo sapiens
  misc_feature: GYAE6OF02FHNKG.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcccgtgggaccgtccctgagactctcctgtgcagcgtctggattcaccttcagtagtcatggcatgcacgtgggccgcaggctccgaggcaagggggctgggaggtggggtggactagttatagtggtatggagtagggaaagtcgtacaaattactagtgacaggacctccggtaggaacgggccgtaattccgaccgtcctaccgagaacgactaactacccgaaagaaccacgcgtacgtatcgtagacaagtcgaaccagcctaggagacgcgaaggacgacggtactataggttacttacgtgtcgacggaggagaggacgacgaccctaacg

SEQ ID NO: 265705 - DNA, 598 bp, Homo sapiens
  misc_feature: GYAE6OF02HU221.34.26.C04.1.454.CMB.1.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctggggttttcctcgttgctctttttaagaggtgtccagtgtcaggtgcagctggtggagtcgtgggggaggcgtggcccagcctgggactcccngagctctcctgtgcagcgtctggattcaccttcagtagtcatggcatgcacgtgggtcccnccgaggcctccgaggccgaaggggctggaggtggggtggctagttatagtggtatgatgggaagttagacaatactatcgacagtacctcggtaggaacgggccgtacttccgacccgttctacccgaagacgaaccaaactaccccaaagaaccaacgtcttagtacttcgtacgaacctaaagtcgaaccgacgtccgtaggacgaacgcccggaaggaccgacgggaccttaagtcgttaattaccgtagttcggacggaggaacggtagaaccgacggaccctaaccgg

SEQ ID NO: 265706 - DNA, 526 bp, Homo sapiens
  misc_feature: GYAE6OF02HP3VG.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcactgggtcccgccaggctccaggcaaggggctgggagtggggtggcaggttatagtggtatgatggaagtagtcaatactatgacagactcgtagaacgggccgatcgaccgtctaccgagagacaactacccaagaacacgctgtatctagacaaagtcaaccgagccagagacgaccgaggaccgacggtacctagtgtacttacgtgtgacgagagaggacagcctaccg

SEQ ID NO: 265707 - DNA, 572 bp, Homo sapiens
  misc_feature: GYAE6OF02HVG6R.34.26.C04.1.454.CMB.1.raw
  modified_base (337)..(337): a, c, t, g, unknown or other
  misc_feature (337)..(337): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtcccgcaggcctccgaggcgaaggggctgggagtggggngcagttatagtggtatgatagggaaagtagtcaaattactatcgcaagtaccgtcggtaggaacgggccgtaattccgaacccgttcctacccgaggacgaaccaactacccgaaagaaccacgctagtactctagacaaagtcgaaccagcctaggagacgaccgaggaccacggtactagttacgttaacttacgttcggtgacggagaacggaacgtaccgacgccctaacg

SEQ ID NO: 265708 - DNA, 577 bp, Homo sapiens
  misc_feature: GYAE6OF02FSXMD.34.26.C04.1.454.CMB.1.raw
  modified_base (440)..(440): a, c, t, g, unknown or other
  misc_feature (440)..(440): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggaccgtccctgagactctcctgtgcagcgtctggatttcaccttcagtagtcatggcatgcactgggtccgccaggctccgaggcaaggggctgggagttggggtggcaggttatagtggtatgatggaagttagtcaattactatgcagactcgtagagggccatcgacgtctccgagagacaactcccaaagtaacacgactntatctagacaaacgtcgaaccgtacgaccgtagacggacgtaccggagggacccacgggtaccttaaggttacgttaacgtttaacgtgggttacggacggtaacggtaggacgaaccgtacggaccccgtaaccgg

SEQ ID NO: 265709 - DNA, 518 bp, Homo sapiens
  misc_feature: GYAE6OF02HPN78.34.26.C04.1.454.CMB.1.raw
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (186)..(190): a, c, t, g, unknown or other
  misc_feature (186)..(190): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggcgtttcggctaggcgtcttaagtaggncantngnnnnngtgngngnggngngngcngcngngctnagnctcngtgcancgctgntcnctcngagtcatgnctgcnctggccgccgnggcncagcgagggngngngnggtgngtagtatagtgtagtagtagtagtagtagtataagtagtagtagagtacgtacgtacgtaggtacggtacgtacgtacgtccgtcgtcgacgacgacgtaactacgaacgacgtactacgtctactactacgtacgtacgtacgacgacgacgtacgagacgacgacgacgtacgtacgtagtacgtacgtacgtacgtacgacgagagacgacgacgtcgtacg

SEQ ID NO: 265710 - DNA, 622 bp, Homo sapiens
  misc_feature: GYAE6OF02HH8EI.34.26.C04.1.454.CMB.1.raw
  modified_base (350)..(350): a, c, t, g, unknown or other
  misc_feature (350)..(350): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacctccctgagactctcctgtgcagcgtctggattccaccttcagtagtcagtggcatgcacgtgggtccgccgaggcctccgaggcgaaggggctgggagtggggtgctagttntagtggtatgagtggaagtgtacaattacatgacagacctccggtagaacgggctactcgacccgtcaccgagacgaacctaacgtacccaaagaacctacgcttaggtaacttcgtaggaacctaaagtccgaaccgtacgtacccgtaagggaccggtaaccggaccggaacgggaccgtaccgggtacgttaacggttacggttaactttaaccggtcggttacggacgggtaacggaaggtaacggaacccgtacgaccccgtaacgg

SEQ ID NO: 265711 - DNA, 543 bp, Homo sapiens
  misc_feature: GYAE6OF02FN6VS.34.26.C04.1.454.CMB.1.raw
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagcgtctggattcaccttcagtagtcatggcatgcactgggtccgccgaggctccgagggccagggggctgggaggtggggtggcagttatagtggtatggatggaaagtgtcaattactatgcagactccgtgaacgggccgattcgaccgtctaccagacacaatacccaagaacacgctgtactctgacaatcgaccacgccgtagacggagtccggaaggaccacggtctaagtgttaacttacgtcggtagacggaggacgagacgtacgcctaaccg

SEQ ID NO: 265712 - DNA, 611 bp, Homo sapiens
  misc_feature: GYAE6OF02F3462.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggccccagccgtgggaccgtccctgagactctcctgtgcagcgtctggattccaccttcagtgtcatggcatgccacgtgggtcccgccgaggcctccgagggcgaaggggctgggaggtggggtggcagttatagtgggtatggagtaggaaagttagtacaagttactagtgacaacgtacgtccggtaggaacgggccgtacgttccgaccgttcctaccaaggacgaaccaacgtacccgaaagaaccgaccgtctagtacttctacgaacaaacgtcgaacctagtaccctagacggaacgacccggaaggaccgaacggcttaagttacggtaattaccgtaggtacgacggtaagtacggaagtaaccgagaccctaacgg

SEQ ID NO: 265713 - DNA, 564 bp, Homo sapiens
  misc_feature: GYAE6OF02IIDH1.34.26.C04.1.454.CMB.1.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcatggcatgcactgggtccnccaggctccaggcaaggggctgggagtgggtggcagttatatggtangatggaagtagtcaatactatgcagactccgtagaacgggccgattcaccgtctccgagacgacaattcccaaagaaccgaccgcttagacttctagacaaatcgaaccagcccgtagaacgtacggaccgaaggaccaacgggtactaagtacgttaagtttaaccgttgtacggtacggaacggtaacggacgaaccgtacgacccgtaacg

SEQ ID NO: 265714 - DNA, 618 bp, Homo sapiens
  misc_feature: GYAE6OF02F2KXR.34.26.C04.1.454.CMB.1.raw
  modified_base (257)..(257): a, c, t, g, unknown or other
  misc_feature (257)..(257): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgctcttttaagaggtgtccagtgtcaggtgcagctggtggagtcgtgggggagcgtggccccagcctgggactccctgagactctcctgtncagcgtctggattcaccttcagtagtcatggcatgcacgtgggtcccgccgaggcctccgaggcgaaggggctgggaggtggggtgctagttatagtggtatggatggaagttagtacaaattactatgactaagaccgtccggtaggaaacggggtccgtaacgtttaccgtacccgttccgtacccgtaaggaacgaacctaaaccgttaccccaaagaaacccgaccgtacgtagtactcgtagacaaagttcgaacccaggtcctaggacgacggaccggaggaccgacggacgttaagtacggttacttaacgtcggttacggacggacggaggaacggaccgacgacccgtaacg

SEQ ID NO: 265715 - DNA, 668 bp, Homo sapiens
  misc_feature: GYAE6OF02ICZNT.34.26.C04.1.454.CMB.1.raw
  modified_base (314)..(314): a, c, t, g, unknown or other
  misc_feature (314)..(314): n is a, c, g, or t
  modified_base (361)..(361): a, c, t, g, unknown or other
  misc_feature (361)..(361): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtgggcccaggccctggggacctccctgacgactctcctgtgcagcgtctggattccacctttcagtagtcaatggcatgcacgttcggggcccncagggcctccgagggcagggggctgggaggtggggtgctaggttaangttgggtaactggaatcggggtaaaagtaggttcaaaagttaaccttagtacggctaacggacccgttacggtacgggaaacggggtcccgtaacgttcccgtaaccggttccctacccgaaggtaacgaaacccgtaaacttaccccgaaaaggtaaccaaccggtacgtacggtaaacttccgtaggaacctaaaagtccgggaacccaacggtcccgtaggacggaacggacccgaagaccgacggtacgtaagttacgtacttaccgtagtacggcgtaaggacgaagtacgaccgctaacgg

SEQ ID NO: 265716 - DNA, 606 bp, Homo sapiens
  misc_feature: GYAE6OF02FH38C.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgagactctcctgtgcagcgtctggattcaccttcagtagtcatggcatgcactgggtccnccaggctccgaggcaaggggctgggagtggggtgctagttactagtgggtatgacgtggaaagtagtacaaattactaatgacagactcggtagaacgggccgtagttccacccggtctaccgagacgaactaactacccgaaagaaccacgacttagtactcgtacgactaaagtcgaaccacggtacctaggaaacgacgtaccggaagggaccgaaccggtcgttaacgttacggttaacgtttaaccgttaggtacggaccggtaagaacgggaagacccgtacggaccccgtaaccgg

SEQ ID NO: 265717 - DNA, 654 bp, Homo sapiens
  misc_feature: GYAE6OF02I7XAZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctggggacgtccctgagactctcctgtgcagcgtctggacttcaccttcagtagtcatggcatgcacgtgggtccgcaggctccagggcgaaggggcttgggagtggggtggctagttatagtgggtatggatgggtaaagtagtactaattacgtatggcaagtaccgtccggtaggaaacggggtccgtaagtaccgtacccgttactacccgaaggtaacgaaccgtaaacttacccgaaacgtaaaccgaacccgtacgttagtaaacttccgtacggtaaacctaaagttaccgggaacctacggtacccgtaggaacggtaacggaccggaacggtaccgaaccggtacgtaacgttacgttaacgttaacgttcggtacgacggtaacggaacggtacgaacgtaccgaccctacgg

SEQ ID NO: 265718 - DNA, 666 bp, Homo sapiens
  misc_feature: GYAE6OF02IG3IQ.34.26.C04.1.454.CMB.1.raw
  modified_base (179)..(179): a, c, t, g, unknown or other
  misc_feature (179)..(179): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagctgggttttcctcgttgcttcttttaagnggtgtccagtgtcaggtgcagctggtggagtcgtgggggagcgtcggcccaggcccgtgggacctccctggacgacttcctccgtagtcgcaggccgtctggtacttcgacctttcgagtagtcagtcggcagtcggcctacgttgggcccaccgaggtcctccgaggccgaaggggctgggtaggtggggtaggactaaggttagtagttggtatggtaagtttagggaaagtacgtacaaattactagtcggcaagtacccgtcggtacggaaacggggtcctaacgttccgaccgttccgtacccgaaaggaacgtaaccaaccgtaacccgaaagtaacccgacgtacttagtacttacgacgaaccgtaaagtccgaacctacgtaccgtaggaacgacggtaccgaaggtaccgtaacggtacgtagtaacggttactaacgttggacgtacggaacggagtacggacaccgacctaccgg

SEQ ID NO: 265719 - DNA, 678 bp, Homo sapiens
  misc_feature: GYAE6OF02JTI6R.34.26.C04.1.454.CMB.1.raw
  modified_base (330)..(330): a, c, t, g, unknown or other
  misc_feature (330)..(330): n is a, c, g, or t
tcagtacacgtgatcacgaccggtgctcgatttagtctagcgactttgggtttggggtcgtgggagaggagcccagcactagaggtcggcggtgtttccattcggtgatcagcactgaacacagaggactcaccatggagtttgggctgagctgggttttcctcgttgcttctttaaggaggtgtccagtgtcaggtgcagctggtggagtcgtgggggagccggtggcccagccgtggggaccgtccctgagacctctccgtgtgacgagcgttgtaggtacttccacctttcagttagtcatggcatcgccacgttcgggtcccacgnggcctaccgagggcaagggggtctggggcggtagggggtcgctaaggttactagtgggtaatcggagttacggaaagttacgtacaaagttacgttagtcggaagtaacggttcccggtaccggtacgggaacgggtaccggtaacgttacccgtaacccgtacgtaccggtaacgaacgtacaaaccgtacccgaaacgaaccgacgtacgtagtacgtacgtacgtacaaacgttacgacccgtacgtaccgtacggacgtaacggcccgaaggaccgtaacggtccgtaagttacgttaagttcgtaggtacggacgtacggagtaacggcgacgtaccaaccgg

SEQ ID NO: 265720 - DNA, 520 bp, Homo sapiens
  misc_feature: GYAE6OF02I87P7.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattcaccttcagtagtcatggcatgcactgggtccgccaggctccaggcaaggggctgggagtggtgctagttatatggtatgatggaagtagtcaatactatgcagactcgtagaagggcgattcgaccgtctaccagacgaacctaactacccgaaagaacacgctagtactctgactaaatcgaccagccgtagacgacgccgaggacacggactagtacgtattacgtgtagacgagagagacagcctaacg

SEQ ID NO: 265721 - DNA, 619 bp, Homo sapiens
  misc_feature: GYAE6OF02I2WND.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctgggtggagtcgtggggggagcgtggcccagccgtgggacgtccctgacgacttctcctgtgcagcgttctggtattcaccttcagttagtcagtcggcatgcacgtcggggtcccgccgaggtcctaccgagggccgaaaggggtctagggaggtggggtggactaggttagtagtgggtatggagtagggaagtacggtactaaagtactagtggacagtactcgtaggaacggtccgtacgttccgaccgttctacgtacgagaacctaacgtaccaaacgaaccacgactgtaactgtacgactaacgtacgaccgacgccttaggaacgaccgtaccgggaacggaccgtacggtacgtagttacgttaagttaccgtggtcggacgaggaacggacgaccgacgcccgtaacgg

SEQ ID NO: 265722 - DNA, 688 bp, Homo sapiens
  misc_feature: GYAE6OF02IGE4U.34.26.C04.1.454.CMB.1.raw
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggcccagccgtgggacgtccctgacgactctcctgtgcagcgtctggacttccaccttcagtagtcagtggcatcgcacgttcgggtcccncgaggcctaccgaggaccgaaggggcttgggaggtggggtgctaggttatagtggtatgagtaggaagtagtacgaattactagtcgactacgtaccgtccggtaggaacgggtccgtacgttaccgacccgttcctaccgaagtaaccggtaacctaaaccgtaaccccgaaacggaacccgtaaccgtacgttacgtaaccttcgtacggaaccttaaacgccgtaacccgtacgtacccgtagggaaccggacggaacccgggacggtaacccgtaaccgggtacttaacggttacgttaacgtttaaccggttaggttacggaaccgggtaaggaacggtaaccggaaccggtaccggacccgtaacccgg

SEQ ID NO: 265723 - DNA, 640 bp, Homo sapiens
  misc_feature: GYAE6OF02HRU06.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggcccagcctgggactccctgacgactctcctgtgcagcgtctggattcaccttcagttagtcatggcatggcacgtggggtcccgccgagggcctccgagggcgaaaggggctgggaggtggggtggcagtttatagtggtatggagttggaaagtgtacaaatactagtgacagtaccgtccggtaggaacgggtccgtagttaccgtacccgttctacccgaggaacgaacctaaactaccccgaaagaacctacggacttacggtacttaccgtagacctaaacgtcgaacccgacgtccctaggaacgaacggacccgggaaggaccgaacgggtacccgttaagttacggttaacgttaaccgtcggttacggacggaagggtacgacggtaaccgccgtacccgtaaccgg

SEQ ID NO: 265724 - DNA, 565 bp, Homo sapiens
  misc_feature: GYAE6OF02IZ7QX.34.26.C04.1.454.CMB.1.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (417)..(417): a, c, t, g, unknown or other
  misc_feature (417)..(417): n is a, c, g, or t
  modified_base (449)..(449): a, c, t, g, unknown or other
  misc_feature (449)..(449): n is a, c, g, or t
tcagtacacgtgatcacgaccggtgctcgatttagtctagcgactttgggtttggggctgggagaggagcccagcactagaggtcagcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccctgggactccctgagacctctcctgtgcagcgtctggattcaccttnagtgtcatggcatgcacgtgggtccncgaggctccgaggcaaggggtctgggagtggggtgcaggttatagtggtatgagtggaagtagtacaaattctatcgacagactccgaggaacgggcctattccgaccgttcnccagacacactaccaagaacacgtctagtacnctagacctaaatcgaacctagtcccgtaggaaacgccgaccggaaggacccaacgggtcttaacgtggttaacttaccggttggtacgacggaaggacgaacggtacctacggacc

SEQ ID NO: 265725 - DNA, 703 bp, Homo sapiens
  misc_feature: GYAE6OF02H4V28.34.26.C04.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
  modified_base (194)..(194): a, c, t, g, unknown or other
  misc_feature (194)..(194): n is a, c, g, or t
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctctttaagaggtntccagtgtcaggtncagctggtaggagtcgngggggancgtggcccaggccctgggaccgtccctggagaccttctccgtgtcgaccagtccgtacgtggacttccacctttcgaaggttacgtcagtggactagtggcctaccgtggggtccccaacgcgggcctcccgagggaccgtaaggggctgggacggttggggaggcctagttaagtagtggtaatcggatagggaaacgttacgtacaaaagttcctaagtcggaacgacggttaccgtacgggtaggaaaccggggtaccgttacgtttacccgacccggttactacccggaaaggaccgtaaccaaacgttaaccccgaaagaaccgttaccgaccgttataacgtacgttaccggaaactaacgtaccgaaccgtacgtaccgaggacgaaccgggaccgtaacgggaacctcggtactaaggttaccgttactaacgttagggcgacggtaagagtaaccggacgtacggaccctaaccgg

SEQ ID NO: 265726 - DNA, 595 bp, Homo sapiens
  misc_feature: GYAE6OF02HHX2W.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggactccctgagctctcctgtgcagcgtctggattccaccttcagtagtcatggcatgcacgtgggtcccgccaggcctccgagggcgaagggggctgggagtggggtggctaggtttatagtgggtatggagtagggaaagttagtacaaagttactagtgactaaggtacttccggtaggaacggggtcccgtatttacccgacccgttctacccgaaggaacgaccaaccgttacccaaaggaacccacgactaggtaactcgtacggacctaaagtcgaaccagcccttaggacgacgaccgacggacgacggtctaagtgttacttacgtagtcgacgaggagagacgacgcctacg

SEQ ID NO: 265727 - DNA, 644 bp, Homo sapiens
  misc_feature: GYAE6OF02G31K9.34.26.C04.1.454.CMB.1.raw
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtgtggattcaccttcagtagtcagtggcatgccacgtcgggtcccnccgaggcctaccgagggacgaagggggtctaggggacggttgggggcggactaaggtttagtagttggggtaatggaagtgggaaagttcggttaacaaattacgtaagtaggaccaaggtactaccggtagggtaacgggtccccgtaagttcccgacccggttaccaccgtaaggaacgtaaccaacgttaacccgaaagaacccacgtccgtagtactccgtaggaccaaagtcgaaccacgtcccgtaggaacgtaacggccggaaggaccgacgggtactaagttcgttaacttacgtggtacgacgacgaaggacgacgtacgcctaacgg

SEQ ID NO: 265728 - DNA, 533 bp, Homo sapiens
  misc_feature: GYAE6OF02GWX91.34.26.C04.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattccaccttcagtagtcatggcatgcactgggtccnccaggcctccaggcaagggctggaggtgggtgctagttatagtggtatgagtggaagtgtnaaatctatgcagactcgtagacgggcctagtccaccgtctaccagacacaagtacccaagaaccncgctagtancgtanacaatcgaccagctagagacggacaggacacggtactagttacgtaacgttactggtacgacggaacggacgaggaaccgacgacctacgg

SEQ ID NO: 265729 - DNA, 860 bp, Homo sapiens
  misc_feature: GYAE6OF02GVLCA.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtcctgagctctcctgtgcagccgtctggattcacttcagttagtcagtggctatcgcacgtgggtcccaaccgaggtcctacccgaggcgaaagggggtctagggacggtgggggttgaccgtaagtttacgtaagtgggttaatgaagtgggtaaaaggttacgtaccaaaagtttacgtaaagtcggtaccgaaggtaacccgttaccggtaacgggtaaacgggggtaccccggtaagtttaccccgtaacccggttacccgttaacccggtaacgggaaacggtaaacccgtaaaacctttaaaccccccgggaaaaacgtaaaaccccggttaaaccggtaacccgttaacggtttaaaccgttacccgttaacccgggaaaccgtaaaaaaccggtttcccggtaaaaccccgaaccgggttacccccggttaaacggtaaaccgggtaaacccgggaaaccccggggtaaccgggaacccgtaaccggggttaaccccggtttaaaggttaacccggtttaaaaccttttaccgggttaccggtttacgggaacccgggtaagggtaaaccgggtaaccggtaacccggaaaccggtaccccgtaaaccccggg

SEQ ID NO: 265730 - DNA, 706 bp, Homo sapiens
  misc_feature: GYAE6OF02I0XM5.34.26.C04.1.454.CMB.1.raw
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccgtggagcctctcctgngcngcgtctggattcaccttgagtagtcagtggcagtcgcgtacgtcgggtcccgctaggcctaccgagggcgaaggggctgggagtggggtgctaggttatagtgggtatcgtaagtaggtaaaggttagtacaaagttactaatcggacaacggtacctaccggtagggaacggggtaccgtagtttacccgaacccggttcctacccgaaggaaacgtaaccgtaaaacccgttccccgaaaaagaaacccgaccgttacgtttaacggtaaccttcgtaggtaacccaaaagttaccgaacccggtaaccgtaccgtaacggaaacggaaccggaaccggtaaacgggaccgtaaccgggtaaccttaggttaacccggtttaataccgttaggtacggttaaccggaagggtaacgtaacggaacgttacgaccccgtaacgg

SEQ ID NO: 265731 - DNA, 612 bp, Homo sapiens
  misc_feature: GYAE6OF02GSHX0.34.26.C04.1.454.CMB.1.raw
  modified_base (304)..(304): a, c, t, g, unknown or other
  misc_feature (304)..(304): n is a, c, g, or t
  modified_base (527)..(527): a, c, t, g, unknown or other
  misc_feature (527)..(527): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattccaccttcagtagtcatggcatgcacgtgggtccnccgaggcctccgaggcgaaggggctagggaggtcggggtgcgtagtttatagttagggtatggaagtcgggaaagttaggtacaaattacgtagtagacctaagtaccgtccggtagggaacgggccgtaatttacccgacccgtcctaccgagaacgaaccaaaccgtacccgaaacgaaccgtaccgtacttcggtaactctagaacctaaagtcgaaccncgactaggacgacgaccggaacgacgacggtacgtataggttactaccgtagtacggtacgaggagacgacgacgtacctaacgg

SEQ ID NO: 265732 - DNA, 728 bp, Homo sapiens
  misc_feature: GYAE6OF02HMDQH.34.26.C04.1.454.CMB.1.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttggggttttcctcgttgcttcttttaaggaggtgtccaggttgtcaggtcgcagctgggtggagttcggtggggggagcggtggcccaggcccgtgggacctccctgacnctctcctgtgcagcgtctggattccaccttnagtagtcatggcatgcgacgtcggggtacccnccgaggtctcccgaggcgaaggggctgggaggtggggngcgtgttaagtgtggtatgaacgttggaagtagtacaaagttactagtgactacggtaccgttacggtacggtaacgggcccgttaagttaccgtaccgtccgtaacgaacggtaacgaaccgtaacctaacccgaaacggaaaccctaaccgtacgttacgttacgttaccgtacgtaaacggttaaactacccgggtaaaccgtaccggttacccgtaacgggtaaacggtaccgggaaccccgggtaagggtaacccgaacccgggtaccgtttaaaccggtttcggtttaaaccgtttaaccggttaggcggttaacgggaagtaaccggggtaaagaccggaaccgtaccccgtaacgggg

SEQ ID NO: 265733 - DNA, 749 bp, Homo sapiens
  misc_feature: GYAE6OF02F7ZK1.34.26.C04.1.454.CMB.1.raw
  modified_base (253)..(253): a, c, t, g, unknown or other
  misc_feature (253)..(253): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggtttcctcgttgctctttaagaggtgtccagtgtcaggtgcagctggtgagtcgtgggggagcgtggcccagccgtgggactccctgagctctctgtgcngcgtctggattccacttcagtagtcatggcagtgccacgtcgggtcccgaccgaggtcctaccgagggaccgaacggggtctaggggaggttcgggggagtccgtaaggtttagtaacggtagggtactaggtagtaacgggaaaagttgtaacgaaagttaaccttagtacgtaccgaacgtacccggtaccgggtaagggtaaccgggtaccgtaactttaccgtaacccgttaccgttaacccgaggtaaaccggtaaccctaaacgtaaccccgaaaaggtaacccgtaacgtccgttacgtaacttcgaacgtaacgaaacgttaccggaaccttaccgtacgtaaggaccgtaacgggaacccggaacggtaacccgtacgggttaaccgttaaggttaaccggttttaacggttaacccggttaagggtacccgaacgggtaaccgggtaacggtaaccggtacgaacccggtaccccgttaaccgggg

SEQ ID NO: 265734 - DNA, 735 bp, Homo sapiens
  misc_feature: GYAE6OF02ICOXI.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaaagaggtgtccagtgtcaggtgcagctggtggagtcgtgggggagcgtggcccagccgtggggacctccctggacgacctctccgtggtacgcaggtccgtctggtacttccaccctttcaaggttagtcaagtggacagttcgccgtaacgtcggggtcccgccgagggtccctaccggaagggacgaaacgggggtctaggggtaggttgggggtcggtaactaaggtttaagtacgttaggggttaatggtaagttagggaaacgtttagtacaaaacgttacgtagtcgacgtaacggtaccgtaccggtacgggtaaacgggtaccgtaactttacccgaccgttaccctacccgtaagaaacgtaaaccaaaccgttaacccgaaaacgtaaacccgaaccgtaccgttaagtaccgttacgtacggaaacctaaagtaccgaaccgtacgacccgttaaggacggtaacggacccggaaggaccgtaacggtacgttagttacgttacttacggtaggtacgacggaggaagacgaccggtacgaccctaacgg

SEQ ID NO: 265735 - DNA, 607 bp, Homo sapiens
  misc_feature: GYAE6OF02HNFE4.34.26.C04.1.454.CMB.1.raw
  modified_base (177)..(177): a, c, t, g, unknown or other
  misc_feature (177)..(177): n is a, c, g, or t
  modified_base (456)..(456): a, c, t, g, unknown or other
  misc_feature (456)..(456): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagcgtgggtggagtcgtgggggagcgtcggcccagcccgtgggaccgtccctgagacctcctccgtgtgcagccgtctggattccacctttcagtagtcagtggcatgctacgtgggtcccgcgaggcctccgaggacgaaggggctgggaggtggggtggctagttatagtcggtatgaagtgggaaagttagtactaaattactagtcgacaagtaccgtcgtaggaacgggccgtattaccgaccgttcaccgaganaccaactacccaaagaacacgtctagtactcgtagaactaaacgtcgaacccacgtcctaaggacgaacgaccggaacggaccgacggtactaagttacgttacttacgtacggtagacggtaaggaagtacggaacacgtacccgtaacg

SEQ ID NO: 265736 - DNA, 620 bp, Homo sapiens
  misc_feature: GYAE6OF02GMA6O.34.26.C04.1.454.CMB.1.raw
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggccccagcccgtggggacctccctgagtacctctcctgtgcagcgtctggattccaccttcagtagtcatggcatgcacgtgggcccnccaggcctccgaggcgaaggggctgggagtggggngctagttatagtggtatggagtgggaagttacgtacaaattactagtgacctaagtaccgtccggtaggaacgggccgtagttacccgaccgtcgtaccgagaacgtaccaacgtacccgaaacgaaccaccgtctagttactactacgaacctaaacgtccgaccgaacgtcccgtaggacggtaacgacccggaacggaccgaccggtacgttaagttacggttaacttacgtagtacggtacggaaggacgacggaactacggaccctacg

SEQ ID NO: 265737 - DNA, 559 bp, Homo sapiens
  misc_feature: GYAE6OF02GJ1JK.34.26.C04.1.454.CMB.1.raw
  modified_base (161)..(161): a, c, t, g, unknown or other
  misc_feature (161)..(161): n is a, c, g, or t
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtcccncaggcctcgaggcaaggggctgggagtgggtgctagttatagtggtatgatggaagtagtacaatactatggacagtaccgtccggtaggaacgggtccgtaattccgacccgttctaccgaaggaacgaacaactacccaaagaaccgacgtctagttatcctagactaaagtcgaccagccgtgaacgacgaccgaacggacgacggtacgtatacgttatacgtgtaggacgaggacgagacgacgacctacg

SEQ ID NO: 265738 - DNA, 568 bp, Homo sapiens
  misc_feature: GYAE6OF02I4KKZ.34.26.C04.1.454.CMB.1.raw
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagcctgggactccctgagacctctcctgtgcngcgtctggattccaccttcagtagtcatggcatgcacgtgggtcccgcaggcctcgaggcaaggggctagggacggtggggtgactagttatagtggtatggatggaatgtacaatctatgacagcgtcgtaggacgggtccgtattccgaccgttctaccgagtacgactaactaccgaaagtaaccacgtactagtactcgtagactaagtcgaccacgccgtagacgaccggaccgtaggaccgtacggtaccgtagtacgttaactagttcgagtacgaaggaacgtacgacgacgtccctaacgg

SEQ ID NO: 265739 - DNA, 555 bp, Homo sapiens
  misc_feature: GYAE6OF02GOGJU.34.26.C04.1.454.CMB.1.raw
  modified_base (305)..(305): a, c, t, g, unknown or other
  misc_feature (305)..(305): n is a, c, g, or t
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctggggttttcctcgttgctcttttaagaggtgtccagtgtcaggtgcagctggtggagtcgtgggggaggcgtggcccagcctgggacctccctgagactctcctgtgcagcgtctggattcaccttcagtagtcatggcatgcacgtgggtccncgaggctccgaggcaaggggctgggagtggggtggctagttatagtgggtatggattgggaaacgttagtacaaattactaatcgacagtaccgtcggtaggaacgggccgtaattccgaccgtctaccgagacgaacgaactacccgaaagaaccacgcttagtactctagacaaatcgacagctagagacgcgagacgacggtntaacgtnttacttagtgtgtacgaggagacgacgacgtaccacg

SEQ ID NO: 265740 - DNA, 604 bp, Homo sapiens
  misc_feature: GYAE6OF02IWCW6.34.26.C04.1.454.CMB.1.raw
  modified_base (275)..(275): a, c, t, g, unknown or other
  misc_feature (275)..(275): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgtttctcttttaagaggtgtccagtgtcaggtgcagctggtggagtctgggggagcgtggcccagcctgggacgtccctgagactctcctgtgcagcgtctggattcaccttnagtagtcatggcatgcactgggtccncaggcctccaggcaaggggtctggagtgggngctagttatatgggtatggataggaatgtacaaattacatggactacgacgtcgtaggaacggcagttcaaccgtctaccaagtacgaactaacgtacccgaaagaaccgtaccgactgtaactcgtacgtacctaaagtcgtaaccgacggtaccctaggtacgaacggacccggtaagggaacgtaccggattacgtacgtttaacgttaacgtaggtacggtacggaacggtacggtaacggaccgaacggtacccgtacgtaaccggg

SEQ ID NO: 265741 - DNA, 734 bp, Homo sapiens
  misc_feature: GYAE6OF02JV6WI.34.26.C04.1.454.CMB.1.raw
  modified_base (255)..(255): a, c, t, g, unknown or other
  misc_feature (255)..(255): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttcctcgttagctctttaagaggtgtccagtgtcaggtgcagctggtggagtcgtgggggagcgtggcccagccgtgggactcctgagacctctcctgngcagcgtctggattcacttcagtagtcagtggctagtcgcaacgtcgggtcccgaccgaggccctacgagggccgaaggggtctagggtaggtggggtgcgtaaggttagtaggtaggtacgtaggaagtagggtaaacggttagtaacctaaaattccgtaaagttcgggactaaacgggtaccgttaccggtaacggaaacggggtacccgtaacgtttacccgaaccggttaccgttaacccgtaacgggaaacctaaaccgaaaccgttaacccgaaaacggaaacgaaccgtaccgttacgtaacgttacccgtagaaaccgtaaacgtaccgaacgaccggttaccgaacgggtaacggtacggaacccggaacggaccggtaaccggtaccgttaacgtaacggtttaaccttaaccggttaggttccgaacggttaacggaacggaggaacccgtacggaccctaaccggg

SEQ ID NO: 265742 - DNA, 719 bp, Homo sapiens
  misc_feature: GYAE6OF02ILH1U.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccaggccgtgggacgtccctggacgactctcctgtgcagcgtctggacttcacctttgagttagtcagtggcatcgcgacgttcgggtcccgccgacgggcctccgagggtaccgaagggggcttaggggtaggttgggggtcggactaaggtttagtaagtggggttaatagggaagtttaggggtaaaagttggtacctaaaagttacctaagtcggacaacgggtaccgttaccggtaggaaaccggggtccgtaagtttacccccgaccggttccgtacccgaagggtaactaacctaaccgtaccccgaaaagtaaccaccggtacttacggtacttaccgaccgtaaactaaaacgtccggaaaccctacggtacctagggaaacggtaccggaacccgggaaggacccgtaacgggacttaacgttacggttaactttacggtcgtacggacgaacggtaaggaaccgaccgtacgacccgttaccg

SEQ ID NO: 265743 - DNA, 566 bp, Homo sapiens
  misc_feature: GYAE6OF02I3K69.34.26.C04.1.454.CMB.1.raw
  modified_base (306)..(306): a, c, t, g, unknown or other
  misc_feature (306)..(306): n is a, c, g, or t
  modified_base (352)..(352): a, c, t, g, unknown or other
  misc_feature (352)..(352): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagcctgggacgtccctgagactctcctgtgcagcgtctggattcaccttcagtagtcagtggcatgctacgtgggtcccnccaggcctccgaggcgaaggggctgggagtgggggtgctagtttanagtggtatgatgggaaagtgtacaatactatgacagtaccgtccggtaggaacgggcctattccgaccgtcaccgagaacgacaactacccgaaagaaccacgctagtactctagactaagtcgaaccacgacctgaacgacgaccgaggaccgacggtactaagtagttacgttacgtggtacggacgtaggagtacgacgacgaccgtaacg

SEQ ID NO: 265744 - DNA, 745 bp, Homo sapiens
  misc_feature: GYAE6OF02I7NGE.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagttcgtgggggagcgtggcccagccgtgggaccgtccctgagtacctcctccgtgtgcagtcgtcgtggtacttccaccttacgagttacgtcacgtgggcagttcgaccgtacggttcggggttcccgaccgtacgggtcctaccggaaggggaccggtaaacggggggtcttaggggacgggtttgggggtcggtaccgtaaggttttaactaggttcggggttaatcggtaaggttagggtaaaagtttacggtacctaaaagttacccttagtacggacctaaggtacccgttacggtagggaacgggtacccgttaacgttcccgtacccggttacctaccgaaggtaaccgaaacgtaaccgtaacccgaaagtaacccgacgtacgttagtaacttacgtaacgacgtaaactcccggtaacgaccgtaccgtaaggtaaccgacggacccgaaggaccgtacggtacttaagtagttacgttaacggtagtaccggacgaaggtacgtaacgacgtaccgacctaaccgg

SEQ ID NO: 265745 - DNA, 560 bp, Homo sapiens
  misc_feature: GYAE6OF02JEZBJ.34.26.C04.1.454.CMB.1.raw
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (366)..(366): a, c, t, g, unknown or other
  misc_feature (366)..(366): n is a, c, g, or t
  modified_base (464)..(464): a, c, t, g, unknown or other
  misc_feature (464)..(464): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggcccagccgtgggacgtcctgagcctctctgngcagcgtcnggacttcaccttcgagtagtcatcggcagtcgctacgtgggtccccncgaggcctcgagggccgaaggggctgggaggtggggtaggactagttatagtgtagngagtggaagtactacgtaaatctagtcgacagtacgtacggaggtaacgggctatacccgcgttacaccgaagaacgaccctaatacccgaaagtacncgtctagtatacgtagaactaagtcgaacgactcgtagagtaccgacgaagacgtacgatagtatatcgngtcgacgganacganacncgcctacg

SEQ ID NO: 265746 - DNA, 885 bp, Homo sapiens
  misc_feature: GYAE6OF02FGYFQ.34.26.C04.1.454.CMB.1.raw
  modified_base (166)..(166): a, c, t, g, unknown or other
  misc_feature (166)..(166): n is a, c, g, or t
  modified_base (220)..(220): a, c, t, g, unknown or other
  misc_feature (220)..(220): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttcgggttttccncgttgcttacgttttaaggaggtctacctagtgtcgaggtcgcgaggtcgtggnggtaggtcggtagggggacgtccggtcggccccgtagtccggtcgggtacccgtccgtaggacgtccttccgttaccggtggtcgaccggtacggttccgttacggtaccggttcttaaccccgttccgttaggttaaggtaccgtatacgggttacggacgtacgtccgggtaacccgtccggggttacccggtacccgacccgggttacggtacccggaacgggtaaccgggtaacgggtaccggggttggtacgggggttaagggttcgggtaaccggttaaggttaacgttaaacggtttagtaagggttaagttaaacggaacgggtttaaggttaaacggttaataacgtaaaccggttatacgggtacccgtaacggtaccgggtaaccggttacggtaacgggtacccggtttaccgttaccggtacccgttaacccgtaacggaaccgtaacgaacccggtaaactaacccgtaaaccggacctaaccgtacccgtacgttaacgtaccgtaagtaccgtaacgtaccgtaccggtaaccgacgttaacggaccggtacggaccgtaaccggtacgacggttaccgttagtaaaccgttggtaacgtaccggtcgtaaacgcggaacgaaccgtcggaacctcggtaccgttacgg

SEQ ID NO: 265747 - DNA, 578 bp, Homo sapiens
  misc_feature: GYAE6OF02I11UT.34.26.C04.1.454.CMB.1.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
  modified_base (565)..(565): a, c, t, g, unknown or other
  misc_feature (565)..(565): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggaccgtccctgagactctcctggtnccagcgtctggtattccaccttnagttatcagtggcatcgcacgtgggtccgcaggcctccgaggcgaaggggctgggaggtgggtgcagttanagtggtatgagtaggaagtagtacaattacgtatgctaagtaccgtccggtaggaaacgggcctaacttccgaccgttcgccgaagacgactaaccgtacccaaagtaacccacgtccgtagtaactccgtagaactaaacgtcgaacctacgacctaggaacgacgacgacggacgacggtctagttagtactacgtgacgacgagtanacgacacgctacg

SEQ ID NO: 265748 - DNA, 607 bp, Homo sapiens
  misc_feature: GYAE6OF02F1OOK.34.26.C04.1.454.CMB.1.raw
  modified_base (404)..(404): a, c, t, g, unknown or other
  misc_feature (404)..(404): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggccccaggcctgggaccgtccctgacgtactctcctgtgcagcgttctggattccaccttcagtagtcagtggcagtcgcacgtcgggtcccgccgaggcctcccgaaggccgaaggggctagggaggtggggtggactagttagtgtaggtatgagtaggaagtagtactaaagttctanggcaaggtccgtccgtagggaaccgggctacgttaccgacccgtacctaccgaagacgaacaaacgtacccgaaacaaccgaccgactgtaactcgagaactaagtacgaaccacgccgtaagacgacggaccgacggaccgacggtacgtaagttcgttaacgttcgtagtacggagtacgaagagaccgacgtcctaacgg

SEQ ID NO: 265749 - DNA, 601 bp, Homo sapiens
  misc_feature: GYAE6OF02I2MVH.34.26.C04.1.454.CMB.1.raw
  modified_base (310)..(310): a, c, t, g, unknown or other
  misc_feature (310)..(310): n is a, c, g, or t
  modified_base (350)..(350): a, c, t, g, unknown or other
  misc_feature (350)..(350): n is a, c, g, or t
  modified_base (391)..(391): a, c, t, g, unknown or other
  misc_feature (391)..(391): n is a, c, g, or t
  modified_base (468)..(468): a, c, t, g, unknown or other
  misc_feature (468)..(468): n is a, c, g, or t
tcagtacacgtgatcacgaccggtgctcgatttagtctagcgactttgggtttggggcgtgggagaggagcccaggcacttaggtagggtcggcggtgtttccattcggtcgatcagcactgaacacagaggactcaccatggagtttgggctagagcttggtttcctcgttgctctttaagaggtgtccagtgtcgaggtgcagctggtggagtcgtgggggagcgtggcccaggcctgggaccgttccctgacgctcctcgtgtgcagcgtctggacttcacctttgagttagtcagtggctatgacncgtgggtcccgcaggcctccgaggcgaaggggtctagggnggtgggtggctaggttatagtggtatgacgtaggaagttanactaattactagtcgacaacgtctccggtagacgggtctattccgaccgtctaccgagaacgacaacgtaaccgaanaaccgacgtctagtactcgtacgaactaacgtcgaaccgtacgtctaggaacgaccgaccggagacgtaccggtagttaacgttgttaacttcgtaggacgtacgaaggacggtacaaccgtacgaccgtacg

SEQ ID NO: 265750 - DNA, 812 bp, Homo sapiens
  misc_feature: GYAE6OF02H20R3.34.26.C04.1.454.CMB.1.raw
  modified_base (240)..(240): a, c, t, g, unknown or other
  misc_feature (240)..(240): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttcttttaagaggtgtccagtgtcaggtgcagctggtggagtcgtgggggagcgtggcccagcctgggactccngacgactctcctgtgcagcgtctggattccaccttcagtagtcatggacatgactacgtcggggtccgccaggcctaccgagggtccaaaggggggtccttaggggaggttcggggggtcggaccgtaaggttttaacgtaagttggggttaaatgggtaataggggtaaaacggttaaggttaacctaaaaagtttaccgtaagttcggacctaaacggtaacccgttacccgggtaagggtaaacgggggtccccgttaaacgttttcccgaaacccggttccgttaaccccgaaagggtaaccggaaacccttaaaaccgttaacccccgaaaaacgtaaaaccccgaaccggttaccttaggttaaaccttaccggttaagtaaacccgtaaaaattcccggaaaaccccgtaacggtacccgttaacggaaacggaacccgggttaaccgggaaccggtaacccggaccgggtaacttaacggtttacggttaactttaaccggtaggttacggaacgggttaacggaacggaacggtaaacccgtaccggtaacccgtaaacccgg

SEQ ID NO: 265751 - DNA, 556 bp, Homo sapiens
  misc_feature: GYAE6OF02JJOLX.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcactgggtccnccaggcctccgaggcaaggggctgggagtggggtgctagttatagtggtatgagtggaagtagtcaaattactagtgactagaccgtccggtaggaacgggccgtatttaccgacccgttctaccgaaggacgaacaacctacccgaaagaaccacgctacgtatctagacaaagtcgaaccagcctagacgacgaccgaaggaccacggtctagtacgtattacgtgtacgacggagagacggacacgcctacg

SEQ ID NO: 265752 - DNA, 672 bp, Homo sapiens
  misc_feature: GYAE6OF02HPCND.34.26.C04.1.454.CMB.1.raw
  modified_base (260)..(260): a, c, t, g, unknown or other
  misc_feature (260)..(260): n is a, c, g, or t
  modified_base (315)..(315): a, c, t, g, unknown or other
  misc_feature (315)..(315): n is a, c, g, or t
  modified_base (341)..(341): a, c, t, g, unknown or other
  misc_feature (341)..(341): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (459)..(459): a, c, t, g, unknown or other
  misc_feature (459)..(459): n is a, c, g, or t
  modified_base (659)..(659): a, c, t, g, unknown or other
  misc_feature (659)..(659): n is a, c, g, or t
tcagtacacgtgatcacgaccggtgctcgatttagtctagcgactttgggtttggggtcgtgggagaggagcccagcacgtagaggtcggcggtgtttccgattcggtgatcagcactgaacacagaggactcaccatggagtttgggctgagctgggttttcctcgttgctcttttaagaggttcgtccagtcgttcgaggtgcagctgggtaggagtcgtcggggggagcgtggccccaggcctggggaccttcccgngagactcggttcctggtcaccgagtccgtcgtggaacttcaccgtttcaggttancaagtggcatcgctaccgtgggtccnccgtaggcttaccgacggcgaacggggtcctgggtacggtcgggnggtcctaaaggtttnaacgttcggttaagcggtaagtggaaaggttactactaaagttacagtgacctaagcncgtcgaacggcgtacttcaccgtactacgtacgacgacaaagttacccaaagtaaccgaccgtagtacgtaattcgtacgtaaacctacgtaacgcctaacgtccgttaacggaaacggccgttaccgggacggtaaccgaggtacccgtaagtaacgttacgtaacggtcgtaacggtcgaacggttacgaacggtacncgtaccgttaacc

SEQ ID NO: 265753 - DNA, 742 bp, Homo sapiens
  misc_feature: GYAE6OF02GRAN1.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgagactctcctgtgcagcgtctggacttccacctttcgaaggttacgtcagtcggctagtcgaccgtacggtcgggtccccgccgaaggtccctaccgagggaccgaagggggtcctaggggacggttgggggtagcgtaagtttaagtacggttgggtaatggaagtttagggaaaagttacggtaactaaagttaaccgttaaggtcgacgtaaacggtacccgttaccgggtaagggaaaccggggtacccgttaacgtttaccccggtaaccccggtttaccgttacccggaaacgggtaaccgtaaacccgtaaaccgttaaacccccgaaaggaaaacccgtacccggtacgttacgttaacgtacgtacgtaaactaaacgttaccgaaccgtacgtaccgtaggaacgaccgggaccgacgaccgtacgtacgttaagtacgttaacgttaccgtgacggtacgaggaacgacacgtaccgccgtaacgg

SEQ ID NO: 265754 - DNA, 903 bp, Homo sapiens
  misc_feature: GYAE6OF02ISX0J.34.26.C04.1.454.CMB.1.raw
  modified_base (177)..(177): a, c, t, g, unknown or other
  misc_feature (177)..(177): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttggctgagctgggttttcctcgttgcttcttttaagnggtgtccagtgtcgaggtgcagcgtgggtaggaggtcgtgggggacgcggtcggcccaggtccgtggggaccgtcccgtaggacgaccttccgttccgtaggtcgaccgaggtccgttcgtagggtactttccaaccgttttcgaagttagtcctaagttcgggactaacggttcgacccgtaaccggttcggggttacccccgccgaagggttccgtaaccccggaaggggtaccccggtaaagggggtcctttaggggaagggttcgggggtgtaacctttaaaggttagtaagtgggttaacgtgaaaggttcggaaagttacgtaacaaacgtttactaacggtcgacgaaccggttacgttaccgggtaagggtaaaccgggtccgttaaacgttcccgtaaaccccggttaccgtaccgggaaacgtaaccggtaaaccctaaaccccggttaacccgaaaaaggtaaccccgtaaccgttacgtttaaaccggtaccctttaaacggtaaccgtaaaccggtaaaaaccgtcccggaaaaaccgttccgggtaacgttaaaccgggtacggaacccgggtacccggttaaacggacccggttaaacggtaccggtttttaaacgtaaccggtttaaccggttacggtttaccggaaccgggttaacggtaaaccgggtagaaaccggtttaacccggaccggttaaccgttaaccgggg

SEQ ID NO: 265755 - DNA, 600 bp, Homo sapiens
  misc_feature: GYAE6OF02FU0I9.34.26.C04.1.454.CMB.1.raw
  modified_base (340)..(340): a, c, t, g, unknown or other
  misc_feature (340)..(340): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgagactctcctgtgcaggctctggattcaccttcagtagtcatggcatgctacgtgggtcccgccaggcctccgaggcgaaggggctgggaggtgggngcaggttatagtggtatgagtaggaagtgtacaattactagtcgacaagtaccgtaccggtaggaacgggtccgtacttaccgaccgtcctaccgagaacgactaacctaccgaaacgaacaccggcttagtacgtctagactaagtacgacctacgtccgtagaacggtaacgaccggaaggaccgacggacttaacgtacggtttaacttaacgttcggtacggacgtaggaacggtaacgacgtaccgactaaccgg

SEQ ID NO: 265756 - DNA, 664 bp, Homo sapiens
  misc_feature: GYAE6OF02GPF85.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagccgtgggactccctgagactctcctgtgcagcgtctggacttcaccttcagtagtcatggcatgcacgtgggtcccgccaggctccgaggcaaggggctggaggtggggtgcgtaggttatagtgggtatggagtagggaacgtagtactaaaagtacttaatcggaacgaagtaccgtacccgggttagggaaacggggtcccgtaacgtttcccgacccgttacctacccggtaaggaacggaaacctaaaccgttaccccgaaaacgtaaccgaaccgtactagttaacttacgtacgaactaaaacgtacgaacccgaacgccgtacggaaggaccggaccggaacgggtaacgaccgggtacttaggtaacgtttaacttacggtacggtacggacgaacggtaaggacgaaccggacgtaccccgtaacgg

SEQ ID NO: 265757 - DNA, 598 bp, Homo sapiens
  misc_feature: GYAE6OF02F7RBC.34.26.C04.1.454.CMB.1.raw
  modified_base (561)..(561): a, c, t, g, unknown or other
  misc_feature (561)..(561): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattccaccttcagtagtcatggcatcgcacgtgggtcccgccgaggcctccgaggccgaaggggctgggaggtgggtgctaggttatagtggtatggagtagggaagtagtacaaattactagtcgactaagtaccgtccggtaggaaccggggtcctaacgtttaccgacccggttcctaccgaaggaacgaacctaacgtacccgaaagaaccacgcttagtactcgtagactaagtcgaaccacgacctagacggacgccggaaggaccgacggactagtacgttacgttacgnggtacggacgaagacggtaacgacgacgccctaacgg

SEQ ID NO: 265758 - DNA, 607 bp, Homo sapiens
  misc_feature: GYAE6OF02JKJ7C.34.26.C04.1.454.CMB.1.raw
  modified_base (272)..(272): a, c, t, g, unknown or other
  misc_feature (272)..(272): n is a, c, g, or t
  modified_base (322)..(322): a, c, t, g, unknown or other
  misc_feature (322)..(322): n is a, c, g, or t
  modified_base (384)..(384): a, c, t, g, unknown or other
  misc_feature (384)..(384): n is a, c, g, or t
  modified_base (486)..(486): a, c, t, g, unknown or other
  misc_feature (486)..(486): n is a, c, g, or t
  modified_base (579)..(579): a, c, t, g, unknown or other
  misc_feature (579)..(579): n is a, c, g, or t
  modified_base (606)..(606): a, c, t, g, unknown or other
  misc_feature (606)..(606): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgacgcctctcctgtagccagcggttcnggacttccaccgttcagtacgtcagtggcatcgctaacgtcgggtacccnccgtaggcctcccggaggcaagggggcttgggacgttggggtggctaggttatagtcggttnacgagtaggagttacgtcaaaattctaagtcgacgagtaccgtccggtagaacgggccgtaatcccgacgtcgaccagtacgacctacgtacccaaagaacnccgtacttaggtaacctcgtacgactaaacgagtacccgacgtacgtcggagccgtaccgggtaagccgaccggtatggtacttagttacggngtacgagtacgaagacgcgaccgtacng

SEQ ID NO: 265759 - DNA, 726 bp, Homo sapiens
  misc_feature: GYAE6OF02FWEVR.34.26.C04.1.454.CMB.1.raw
  modified_base (383)..(383): a, c, t, g, unknown or other
  misc_feature (383)..(383): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagtctctcctgtcgcagcgtcgtggattccaccttcagttagtcagtggctatcgacgaccgttgggtccctacgaggtcctaccgagggccgaagggggccttaggggacggttggggttcggactaacggttttaanagttggggttataggaagtttacgggaaaggtttacgtaactaaagttacgttaagttcggaactaacggtacccgttaacccgggtaggggtaaaccggggtacccgttaacgtttacccgtacccgttaccgtacccgtaaaggaaaccgtaaccgtaaaccgttaacccgaaaaggtaaacccgaccggttaccttaacggtaccttacgttacgaacctaaagtccgtaacccagtaccgtaagaacggacgacccggtaaggaaccgtacggagttaacgtagtaacgtttaccgttaggtacggacgtagaacggtacgtaaccgacgacctaaccg

SEQ ID NO: 265760 - DNA, 548 bp, Homo sapiens
  misc_feature: GYAE6OF02IVDOY.34.26.C04.1.454.CMB.1.raw
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (374)..(374): a, c, t, g, unknown or other
  misc_feature (374)..(374): n is a, c, g, or t
  modified_base (537)..(537): a, c, t, g, unknown or other
  misc_feature (537)..(537): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtggggtccnccgaggcctccgaggcaaggggctgggagtgggngctagttanagtggtatgatggaatgtacaatctangacagactccggtagaacgggccattcaccgtcacgagacacaactacccaaagaaccacgcttagtactctgactaaatcgacctagccctagacggacgacccggaggaccacggtacttagttaccgttattaacgtggtacgacggtaggtagaggacncgacctaacgg

SEQ ID NO: 265761 - DNA, 556 bp, Homo sapiens
  misc_feature: GYAE6OF02GB85V.34.26.C04.1.454.CMB.1.raw
  modified_base (302)..(302): a, c, t, g, unknown or other
  misc_feature (302)..(302): n is a, c, g, or t
  modified_base (504)..(504): a, c, t, g, unknown or other
  misc_feature (504)..(504): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccnccaggctccaggcaaggggctgggagtggggtgctagttatagtggtatgatggaattagacaaattacagtcgacaagacctccggtaggaaacgggccgtaagttaccacccggtcctaccgaagtacgacaactacccaaagaacaccgctacgtactctacgactaaagtcgaaccagacctgagacgaccgaggacncggactagtacgttattacgtgtagacggagaagacgaacgacgtcctaacg

SEQ ID NO: 265762 - DNA, 543 bp, Homo sapiens
  misc_feature: GYAE6OF02IW5VC.34.26.C04.1.454.CMB.1.raw
  modified_base (153)..(153): a, c, t, g, unknown or other
  misc_feature (153)..(153): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (185)..(185): a, c, t, g, unknown or other
  misc_feature (185)..(185): n is a, c, g, or t
  modified_base (187)..(188): a, c, t, g, unknown or other
  misc_feature (187)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (221)..(221): a, c, t, g, unknown or other
  misc_feature (221)..(221): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (229)..(229): a, c, t, g, unknown or other
  misc_feature (229)..(229): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (250)..(252): a, c, t, g, unknown or other
  misc_feature (250)..(252): n is a, c, g, or t
  modified_base (254)..(256): a, c, t, g, unknown or other
  misc_feature (254)..(256): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggngttgctaaggcgcttaagaggtncngncagtncnngngngngnggngngngcngcgngngcngngncncngngcgngcgtcgtgngtctctnagtgnnngnnncncgcgcgcgcgcncgagcgngngngaaaaaaagnggngngngtagtagtagtagtagtagtaggtagtagtagtaactacgtagtagacgtacgacgtacggtacggacggacgtacgtacgtaccgtccgtacgtacgagaacgaacgaacgaaacgaacgacgactacgtacgtacgtacgtacgtaacgaacgacgaccgaccgacgaacgacgacgtacggacgacggtacgtacgtacgttagtagtacgtagacgacggtagacggacgacgtaccgacg

SEQ ID NO: 265763 - DNA, 564 bp, Homo sapiens
  misc_feature: GYAE6OF02IBVPD.34.26.C04.1.454.CMB.1.raw
  modified_base (178)..(178): a, c, t, g, unknown or other
  misc_feature (178)..(178): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtctgggggagcgtggcccagccctgggcctccctgacgactctccgtgtcgacagcgtcctggacttcacctttgagttagtcatggcatgcactgggtccncaggctccgaggcagggctgggagtgggngcagttagatggtatggataggtaagtgactaaagtcctagtgactacgactccggagaacgggccgtatccgacgtctacgaagacgacaaacgtcccaaagaaccacggtctacgtatctagactaatcgaactcgcctagaggacacccggagaccgacggtactagtacgttaacgttacgtgtaggacgtaagggaacgtaacgcgtaaccgcctaaccg

SEQ ID NO: 265764 - DNA, 637 bp, Homo sapiens
  misc_feature: GYAE6OF02H2PN1.34.26.C04.1.454.CMB.1.raw
  modified_base (426)..(426): a, c, t, g, unknown or other
  misc_feature (426)..(426): n is a, c, g, or t
tcagtacacgtgatcacgaccggtgctcgatttagtctagcgactttgggtttggggctgggagaggagcccagcactagaggtcggcggtgtttccatttcggtgatcagcactgaacacagaggactcaccatggagtttggctgagcttgggttttcctcgttgctcttttaagaggtgtccagtgtcaggtgcagctggtggagtcgtgggggagcgtcggcccagccgtgggaccgtccgtgacgacctcgtcctggtcgactaggccgttcgtggtacttccgaccttcgaggtacgtcagtggcatgacctacgttcggtcccgcgaggcctaccgaggcggaaggggcgtgggaggtggggtcggactagttacgtgttaggtatgacggttaggaagttagttacaaattacgtagngactaagtcccgtcggaacgggacggtacctacgttcccgacgttccgtaaccgagaccgtaaacctaacgtaacccgaaagtacgaccgtctaggtacttcgtaccggaataaaccgtccgaacgtccgtacgaggacgaccggacgacgaaccgtcggtactagtacgttactacggtgtcgacggtagaggacacggcgtactaaccg

SEQ ID NO: 265765 - DNA, 568 bp, Homo sapiens
  misc_feature: GYAE6OF02H691E.34.26.C04.1.454.CMB.1.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (465)..(465): a, c, t, g, unknown or other
  misc_feature (465)..(465): n is a, c, g, or t
tcagtacacgtgatcacgaccggtgctcgatttagtctagcgactttgggtttgggctgggagaggagcccagcactagaggtcggcggtgtttccatttggtgatcagcactgaacacagaggactcaccatggagtttgggctgagctgggttttcctcgttgctcttttaagaggtgtccagtgtcaggtgcagcgtggtggagtcgtggggggaggcggtggcccagcctgggacgtccctgagactctcctgtgcagcgtctggattcaccttnagtagtcatggcatgcacgtcggggtcccnccgaggcctccgagggccgaagggggctgggaggttggggtaggctaaggttatagtgggtatggaagtgggaactagtcaaattacatgacagtactccgtaggaagggccgattccgaccgtcaccagagaacaaactacccaaagaacacgtntagtaactcgtacgactaaacgtcgaaccagcctaggagacgaccggagacgacggactagtcgttaataccgtgaggcgaggagaacgacgtaccgcctacg

SEQ ID NO: 265766 - DNA, 508 bp, Homo sapiens
  misc_feature: GYAE6OF02FO9DR.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggaccgtccctgagactctcctgtgcagcgtctggattcaccttcagtagtcatggcatgcactgggtccgccaggctccaggcaaggggctgggagtggggtgcagttatagtggtatgatggaagtagtcaatactatgcagactccgtagagggccgattcaccgtctccagagacaactcccaagaaccacgctgtactctagacaaagtcgaccagcctgacgagaccgagacacggctatgtattactgtgacgaggagagacacgccacg

SEQ ID NO: 265767 - DNA, 541 bp, Homo sapiens
  misc_feature: GYAE6OF02FMVN7.34.26.C04.1.454.CMB.1.raw
  modified_base (347)..(347): a, c, t, g, unknown or other
  misc_feature (347)..(347): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccaccgaggctccgaggccaaggggctgggagtcggggtgctagttanagtggtatggatgggaaagtagtcaatctatgacagactcgtaggaagggccgtattcgaccgtctccgagacgacaactacccaagaacacgtctgtactcgtacgacaaatcgaaccagccctaggacgacgaccgacggacgacggactaagtgttaagttactgtgacggagagagacgacgacctaacg

SEQ ID NO: 265768 - DNA, 751 bp, Homo sapiens
  misc_feature: GYAE6OF02H3XN8.34.26.C04.1.454.CMB.1.raw
  modified_base (193)..(193): a, c, t, g, unknown or other
  misc_feature (193)..(193): n is a, c, g, or t
tcagtacacgtgatcacgaccggtgctcgatttagtctagcgactttgggtttggggctgggagaggagcccagcactagagttcggcggtgtttccattcggtgatcagcactgaacacagaggactcaccatggagtttgggctgagctgggttttcctcgttgctctttaagagtgtccagtgtcaggtncagctggtggagtcgtgggggagcgtggcccagcctgggaccgtccctgagactctcctgtcgcagcgtctggacttcaccttcagtagtcatggcatgcctacgtcgggtcccgccaggcctaccgaggcccgaagggggtcctaggggtggtggggtggctaggttatagtggtatagtagtagggtaaagttagtcaaattacgtagtacggactaacggtacccgttaccgggtagggtaaacggggtaccccgtaacgtttaccccgtacccggttaccgttacccgaacgggtaacgtaaacccaaaaccgttacccccgaaaaggaaaccctaaccggttaacgtacggtttaaaccgtaccgttaacggaaaccgtaaacgtaccggaacccgaaccggttacccgtaacgggaacggaaccggggtacccggaaacgggtaacccggtacccgggtaaccgtaacggtttacggtttaaaccgttaccggtttacggtacggtacgggtaacggaacggtaaccggaacgtacccggaccgttaaccgg

SEQ ID NO: 265769 - DNA, 568 bp, Homo sapiens
  misc_feature: GYAE6OF02G8C82.34.26.C04.1.454.CMB.1.raw
  modified_base (448)..(448): a, c, t, g, unknown or other
  misc_feature (448)..(448): n is a, c, g, or t
  modified_base (466)..(466): a, c, t, g, unknown or other
  misc_feature (466)..(466): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctccgtgtgcagcgtctggacttccaccttcagtagtcagtcggcatgcacgtgggtcccgccgaggcctaccgagggcgaaggggctgggaggtggtggctagttatagtgtagtgagtaggagtagtacaatactagcgacaagtaccgtcgtaggaacggtccgtactcaccgttcaccgagaacgacaacacccaanaaccgacgctagtactcncgtaacaagtcgaaccacgacctaggacgaacgccgaggaccacggtactaacgttagttacttaccgtgtaggacggtaggaacgaggaccgacgcctacg

SEQ ID NO: 265770 - DNA, 638 bp, Homo sapiens
  misc_feature: GYAE6OF02I02B9.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgacgactctcctgtcgcagcgtcgtggattccacttcagtagtcatggcatgcacgtgggtccnccaggcctccgagggcgaaggggctgggagtggggtgcagttatagtgggtatggagtggaaagttagtactaaagtctaagcgtacgaacgtacgttccgtagggaaacgggtaccgtacgttaccgaacccgttcctaaccgagaacggacccgtaaactacccgaaacggaccgtaaccggtcgttagttacgtaccgtagtaacccgaaagtccgaacccaggtacccgttggaaacggtaacggaccgggaacggaccgaacggtactagtttaacgtacttacgtcgtacggtacggacggtaagacggacacggtacctaaccgg

SEQ ID NO: 265771 - DNA, 552 bp, Homo sapiens
  misc_feature: GYAE6OF02HGMW8.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccctgggacgtccctgagactctcctgtgcagcgtctggattcaccttcagtagtcatggcatgcacgtgggtcccgccgaggcctccgagggcgaagggggctgggaggtggggtggctagttatagtgggtatgagtaggaagtagtacaaattactatgacagtactccgtaggaacggccgtattcgaccgtctaccgagacgaacaactacccgaaagaaccacgtctgtactctagacaaatcgaccacgccgtagacgacgccgaggaccacggtatagtagtattacgtgtagacgaggagagaccagccgtacg

SEQ ID NO: 265772 - DNA, 715 bp, Homo sapiens
  misc_feature: GYAE6OF02H2472.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgcttctttaagaggtgtccagtgtcaggtgcagctggtggagtcggtgggggagcggtcggccccaggcccgtgggaccgttcccgtaggacgaccttccgtcccgtggtcgaccaggtccggttccgtaggtactttccgaccctttgagttagtcagtggcagtcgctacgtcgggtcccgcgaggcctccgagggccgaaggggtctgggtaggtggggtacgacttaaggtttatacggttgggtaatggaagtagggtaaaatacggtcaaaattctagtcgacgtaaccgtcgtaccggtggaaacgggtccgtacttaccgacccggttactaccgtaaacggaacgaacctaaaccgtaacccgtaaacgaactaccggtacgtacgtaactccgtacgtaaccgtaaacgtccgaaccgacgtaccctagggaaccggacgaacccggaacggaccgtaaccggtcgtaagttaccggttaacgttacggttacgacggtacgtacggtaacgaaccggtaaccgtaccgtacgtaacccg

SEQ ID NO: 265773 - DNA, 655 bp, Homo sapiens
  misc_feature: GYAE6OF02J1K3R.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtgggtcccnccaggcctccgagggccgaagggggctagggacgtggggtacggctagttatagtgggtatcggatggaaacgtgtacaaatcctaagtcgactacggacgtcccggtaggaacggggtcccgtaacgtttccgaacccggttccgtaccgaacggaaggaacctaaacgttaccccaaaggaaaccctaccggcgttacggtaatttaccgagtaccgtaaactacggaaccctacggtacccgtaaggacggaccggaccgggaacgggaaccacgggtaccgtaattaccggttaattaccgttcggtaggaccggtaagaacggacgaacgtacggaccctaacgg

SEQ ID NO: 265774 - DNA, 618 bp, Homo sapiens
  misc_feature: GYAE6OF02IHPZO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgacgactctcctgtgcagcgtctggacttcaccttcagtagtcatggcatgcacgtcgggtccgccaggcctccgaggcgaaggggctgggaggtggggtggcaggttatagttgggtatgagtgggaaagtaggtacaaagttactaatcgactagtactccggtaggaacgggccgtaatccgacgtctaccgagacgacaacgtacccaaagaacacgtactacgactcgtacgactaaacgtcgaaccctacgtcctagggaacgaccggaacccggaacggaccgtaaccggtaccgttaacgttacgttaacgtttaccgtacggttacggacggaacggtacggaaccggtacaccggtaccctaaaccgg

SEQ ID NO: 265775 - DNA, 631 bp, Homo sapiens
  misc_feature: GYAE6OF02JK83A.34.26.C04.1.454.CMB.1.raw
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (493)..(493): a, c, t, g, unknown or other
  misc_feature (493)..(493): n is a, c, g, or t
  modified_base (564)..(564): a, c, t, g, unknown or other
  misc_feature (564)..(564): n is a, c, g, or t
tcagtacacgtgatcacgaccggtgctcgatttagtctagcgactttgggtttggggtcgtgggagaggagcccagtctactagaggtcggtacggtgtttccattcggtgagtcagcactgaacacagagggactcaccatggagtttcggggctgagctgggtttcctcgttgctcttttaagnggtntccagttgtcaggtgcagctggtggagtctgggggagcgtgggcccgaggccgtggggacgtcccgtgaagacttcctcgtggtgccgagtcgtctggtaattcctaccgttnaaggttacgtccaagttcgggacctagtgacgtacgtcggtacccgccgtaaggcctcccggaggaccgaaaggggcctaggacggttggggtcgactaagtttanacgtgtaatgaagttggaagtgtacaagtactatcgactagtcncgtagaggactnctaccgtnacgagacacactaccgaaanacgtcgactgtaactccgtagcttaaacgcgaccgtacgacctacggagaaccgtacgacgtacgaaccgngttaaccgtacttacggtaaccgtcgtacggtacgacgttaccgacggtaacgaccgacccctaacg

SEQ ID NO: 265776 - DNA, 667 bp, Homo sapiens
  misc_feature: GYAE6OF02FZHJF.34.26.C04.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccaggccgtgggaccgtccctgagctctcctgtgcagcgtctggnttcaccttcagtagtcatggcagtcgcacgtgggtccnccaggcctccgaggcgaaggggtctgggagttggggtcgctaggttatagtgggtatggaagtgggtaaagttagtactaaagttactagtgactaagaccgttcggtaggaacgggtcccgtaagttcccgaacccgttccgtaccgaaggtaacgtaaccgtaacctacccgaaaggaacccacggtacttagttactaccgttaggaacctaaagtccgaacccgacgtaccgtaggacgaccggtaccggaacggacccgtacgggtacttaacggttacggttaacgtttaacccggtaggttaccggtaccgtaagggaaccgtaacggtaacccggacgtccccgtaaaccgg

SEQ ID NO: 265777 - DNA, 746 bp, Homo sapiens
  misc_feature: GYAE6OF02I951U.34.26.C04.1.454.CMB.1.raw
  modified_base (292)..(292): a, c, t, g, unknown or other
  misc_feature (292)..(292): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (573)..(573): a, c, t, g, unknown or other
  misc_feature (573)..(573): n is a, c, g, or t
  modified_base (694)..(694): a, c, t, g, unknown or other
  misc_feature (694)..(694): n is a, c, g, or t
tcagtacacgtgatcacgaccggtgctcgatttagtctagcgactttgggtttgggggctggggggaggaggccacgcactagaggtcgggcgggtggtttcctacttcggttggatcagcactgaacacagaggacgtcaccatggtagtttgggtcgtgagcgtgggttttcgttcgttgctacttttaagtaggtgtccagtgtcgaggtgcagcgtggtggaagtcgtgggggagggcgtggcccagccgtcggggacgtcccctgaggacctccttccctggtgacncgcgtcgtggattaccnccttctaggtagtcatggnactgcgtaccgtggggtcccgccgtacgccgtccgacgggacggaaacgggggtcgtcgggtagggtcggggtggaacagggtttaatagttaggggtattaggtacgtagggtaacggtaatactaaagttaactaacgtggctacggaacgttccgagggaacgggtaccgtacttacgaacccgttcgtccaaaggtgaaacctaactaccccggaaagaaccgaaccggtcgtagttaccncgttacgaacgtaaacgtacgtaacccgaggtaccgttcggaaacgggaaccgacccggggttaacgggaaacccgttaaccgggtagtttaaccccgttaaaggttttcccgttaaacgnggtttaacgggacgaacgtaggtaacgacccgagtacccgacggttaccggg

SEQ ID NO: 265778 - DNA, 553 bp, Homo sapiens
  misc_feature: GYAE6OF02FWIJ3.34.26.C04.1.454.CMB.1.raw
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagctctcctgtgcagcgtctggattcaccttcagtagtcatggcatgcacgtgggtccnccaggctccgaggcaaggggctgggagtgggtgctagttatagtggtatgagtggaagtagtcaatactagtgacagaccgtccgtaggacggccgtattccgaccgttcctaccgaagacgacctaacgtacccaaagaaccaccgtactacgttactcgtacgactaaacgtcgaaccgtacgccgtagacgacgaccggtacgacgacggactaagtgttactagtgtgacgagagagacagcctacg

SEQ ID NO: 265779 - DNA, 551 bp, Homo sapiens
  misc_feature: GYAE6OF02GF0DN.34.26.C04.1.454.CMB.1.raw
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtgcagccgtctggattcaccttcagtagtcatggcatgcacgtgggtccnccaggcctccgaggccgaaggggctgggagtggggtgcgtagttatatggtatgagtggaagtgtacaatactatgacagacctcgtagaacgggccgtattacgaccgttccgtccgaagacgaaccaactacccaaagaaccaccgactagtatccgtagaccaagtcgaacgacgtcctagagacgaccgagacgacggctaagtacgtattacgtgtgacgagagacgacgacgacctacg

SEQ ID NO: 265780 - DNA, 676 bp, Homo sapiens
  misc_feature: GYAE6OF02JYU23.34.26.C04.1.454.CMB.1.raw
  modified_base (169)..(169): a, c, t, g, unknown or other
  misc_feature (169)..(169): n is a, c, g, or t
  modified_base (314)..(314): a, c, t, g, unknown or other
  misc_feature (314)..(314): n is a, c, g, or t
  modified_base (459)..(459): a, c, t, g, unknown or other
  misc_feature (459)..(459): n is a, c, g, or t
  modified_base (542)..(542): a, c, t, g, unknown or other
  misc_feature (542)..(542): n is a, c, g, or t
  modified_base (552)..(552): a, c, t, g, unknown or other
  misc_feature (552)..(552): n is a, c, g, or t
  modified_base (612)..(612): a, c, t, g, unknown or other
  misc_feature (612)..(612): n is a, c, g, or t
  modified_base (621)..(621): a, c, t, g, unknown or other
  misc_feature (621)..(621): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatgggttggtcgtgagctggtttccgttccgttgtntctttaagtaggtgtcacgtgtgacgtggcagcgtggtaggtggtcgtggggagggcgtcggaccgcgcgtcgggacggtcccctgagactcctcctagtgcgaacgcgtcgtggtattacctacccttcgtagtaagtccgtangggtcaatcgcgtaccgtggggtacccggtcccacggacgtcccacgggagttaaacgggggccggtaggagggtggggtggggccaaggtttaagattccgggtaagtgagtaccgggtaagaagtcccaaatacgtaatcggnaacgtagtacccgtaggaacggaccgtagtaccgtacccgtacgtaccaaccgaggaacaacgtaccaaacgtaaccgaaacncgtagttacnctacgagtaaaccttcgaaccgaaccgtcgtacgaagacgtaaccggacgtacgacggtnttaacggtnttacgtaattggcggtacgaccggtaaggacgttaagacgtaccgaccttacggg

SEQ ID NO: 265781 - DNA, 611 bp, Homo sapiens
  misc_feature: GYAE6OF02IOMQ9.34.26.C04.1.454.CMB.1.raw
  modified_base (257)..(257): a, c, t, g, unknown or other
  misc_feature (257)..(257): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggccagccgtgggacctccctgagactctcctgngcagcgtctggattcgaccttcgagtagtcatggcatgcacgtcgggtccgccaggctccgaggcgaaggggtctgggagtggggtgcgtagttagtagtggtatggatagggaatagtactaagttactaggtcgacgtagaccttccggtagggaacgggtccgtaactttcgaacccgttccgtaaccgagtaacgaacctaacctacccgaaagaaccgccgacttaggtactacgtagactaagtacgaccgtagtacctaggacgaacgaccggacggaccgacgtacgtagttacgttaattaccggtggtacgacggtaggtacgaacgacgtacggccctaacgg

SEQ ID NO: 265782 - DNA, 601 bp, Homo sapiens
  misc_feature: GYAE6OF02FYGV9.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatcgcacgtcggggtccnccgaggcctaccgaggccgaaggggtctgggacggtggggtgcaggttatagtggtatgagtggaagtatacgaaatctaagtgaccagactcgtaggaacgggtcctattccgaccggtctaccgaaggacgaaccaactacccgaaagtaaccaacgcttacgtaactcgtacgacaaagtccgaaccgagcctaggaacggacgaccggaacggaccgaacggtaccttaagtacgttaacttacgttaggtacgaccggaagtacggaacgaaccgacggtaccgtaacccg

SEQ ID NO: 265783 - DNA, 553 bp, Homo sapiens
  misc_feature: GYAE6OF02GESNB.34.26.C04.1.454.CMB.1.raw
  modified_base (161)..(161): a, c, t, g, unknown or other
  misc_feature (161)..(161): n is a, c, g, or t
  modified_base (307)..(307): a, c, t, g, unknown or other
  misc_feature (307)..(307): n is a, c, g, or t
  modified_base (463)..(463): a, c, t, g, unknown or other
  misc_feature (463)..(463): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagaggtgtccagtgtcaggtgcagctggtggagtctgggggagcgtggcccagcctgggacgtccctgagacctctcctgtgcagcgtctggacttccacctttcagtagtcagtggcatgcacgtgggtccnccgaggcctccagggcgaaggggctgggagtggggtcgcagttatagtggtatgatgggtaatagactaatactagtgacaagtacctcggtagaacgggcctagttccacccgtcaccgagaacgacaactacccaagaacacgctagtatcgtnacaatcgaccagccgtagacgaacgaccggacggacgacggtactacgttagttacttacgtgtggacgaggacgacgacaccgactacg

SEQ ID NO: 265784 - DNA, 535 bp, Homo sapiens
  misc_feature: GYAE6OF02FKZL3.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagtgtggcccagcctgggacgtccctgagactctcctgtgcagcgtctggattcaccttcagttagtcatggcatgcactggggtccgccaggcctccgagggcaagggggctgggagtggggtggctagttatagtggtatgagtgggaagtagtcaattactatgcagacctcggtgaagggccgattccgaccgtctaccagacgacaactcccaaagaacacgctgtactctgacaaacgtgaaccagcctgacgacgccgaaggacgacggctaagtgttattacgtggtgtcggaggagagacacggcctaacg

SEQ ID NO: 265785 - DNA, 662 bp, Homo sapiens
  misc_feature: GYAE6OF02G418Q.34.26.C04.1.454.CMB.1.raw
  modified_base (367)..(367): a, c, t, g, unknown or other
  misc_feature (367)..(367): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctggagctctcctgtgccagcgtctggtacttccacctttcagttagtccaagtcggactagtgcctacgtcgggggtcccgccgaggcctaccgagggcaagggggtctggggaggttgggggnggactaaggtttacgtagttaggggttaattggaaggttagggaaacggttagtacgaaagttactagtacggcaacgtaccgtccggtaggaacgggtaccgtacgttaccgacccgttactcccgaacggtaacgaaccaaaccgtaacccgaaacgaaccgaccgtacttagtacctacgtcgaacctaagtacgaacctacggccgttaggacgtacggaccggaggacgtaccggtctaagtagttacgttagtcgttaggacggagaaggacgaccgacgtccctacgg

SEQ ID NO: 265786 - DNA, 729 bp, Homo sapiens
  misc_feature: GYAE6OF02GEQNW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctggagctgggttttcctcgttgctcttttaagaggtgtccagtgtcaggtgcagctggtggagtcgtgggggagcgtggcccagcctgggacgtccctggacgactctccgtgtcgcagcgtctggacttccacctttcgagttacgtcagttggctagtcggcctacggttcggggtcccaccgagggcctaccgtaggggcccgtaaaggggggcttacggggtagttggggggtcgtccgttaagtttacgtaggtcggttattgggaagttagggtaaaagttcggtactaaacgtttaccgtagtcggacctaaggacccgttaccggtaagggaaccgggtccgtaacgttaccgacccggttacgtaccgacggtaaaccgaacctaacgtaacccgtaaacgaaccgtaccgtcgtaacgttaacgtacgtacgaacttaacgtacgtaacccgtacggtccgtaagtaacggaccggaccgtaacccgggactacgggtactttaacgtacggtttaacgttaccggtggttcgacgggtaggtaaccgggacctaccggacccgtacgtacggg

SEQ ID NO: 265787 - DNA, 692 bp, Homo sapiens
  misc_feature: GYAE6OF02HXJKS.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggacgtccctgacgacctctcctgtcgcagcgttcgtaggacttccacccgtttcaggttacgtcagtggccagttggcctacgtcggggtcccgccgaggtcctccgagggccgaagggggtctaggggtaggtgggggtcggacgtaaggtttataggttacgggtaagtaggtagttacgggaaaggttacggtacaaagtttactaagttcgacgtaacgtaccgttacggtcgggtaaacggggcccgttattcccgtacccgttccgtaccgaacgtaacgaacctaaccgtaaccccgaaagaacctaccgtcttacggtaacttcgtacgtaacctaaacgacgaaccgtacgacctacgggaaggaccgaccgggaacggacccgacggtacgttaacgtcgttaagttacgtggtacgacgtaacgagtacgacgtacgacctaacgg

SEQ ID NO: 265788 - DNA, 799 bp, Homo sapiens
  misc_feature: GYAE6OF02G5792.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacctccctgagactctcctgtgcagcgtctggacttcaccttcagtagtcagtggcatgctacgtcgggtcccgaccgagggcctaccggaggtaccggaaagggggtccgttaggggacgggttggggggtacggacgttaaggtttaagtacggttagggttaatggtaagttagggtaaaggttacggttactaaaacgttacgttaagttacggaccgtaaacggttacccggttaccgggtaacgggtaaaccgggggtaccccggtttaaactttccccggtaaccccggttacctaacccggtaacgggtaaaccggaaacccttaaaccggttaaccccgaaaaacggtaacccaacccggtcgttaacgttacgtaccggtaaggttaaacctaacgttaccgaaacccgtacggtacccggttaacggaaacggaccgggacccgggtaacgggtaccgtaaccgggtacttaacggttacggtttaacttaaccggttaggttacggaccggtaaggaacggaacccggacgtacccggtaccccgtaacggg

SEQ ID NO: 265789 - DNA, 625 bp, Homo sapiens
  misc_feature: GYAE6OF02I4M1M.34.26.C04.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacctccctgacgactctcctgtgcngcgtcnggattccaccttcagtgtcagtggcatgctacgtcgggtcccgccaggcctccgaaggccaagggggctgggagtggggtgcgtagttatagtggtatggagttggaagttagtactaaattacgtaatgacgtaagtaccgtccggtaggaacgggtccgtaatttcccgaccgtctacccgaaggaacaaccaaactacccgaaagaacccgacgtcgttacgtactacgtagaacctaaagtccgaaccgtacgtaccgtaggaacgtaacggacccgtaacgggaccaccggtaccttaagttacgttaacgttcgtaggtacgacggtagaacgacgaaccgacgaccgtaacg

SEQ ID NO: 265790 - DNA, 622 bp, Homo sapiens
  misc_feature: GYAE6OF02J08BD.34.26.C04.1.454.CMB.1.raw
  modified_base (178)..(178): a, c, t, g, unknown or other
  misc_feature (178)..(178): n is a, c, g, or t
  modified_base (241)..(241): a, c, t, g, unknown or other
  misc_feature (241)..(241): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtgcccagcctgggacctccngacgactctcctgtgcagcgtctggattccacttcagtacgtcagtggcatgcacgtggtcccncgaggcctcgaggccgaaggggctagggagtggggtgacgtaaggttatagtacggtataggagtagggaaagttgtacaattactagtanaccgagtaccgtccggtaaggaacgggccgttacgtccgaccgttcaccgaggtaacgaacctaactacccgaaagaaccgaccgtactacggtacttacgagtaacctaacgtccgaacgacgaccgttacggaacggtaaccggaccgtaacgggacgtaccggtacgtaagttacggttataccggtgtacggacgtaggacgaacgacgtacgaccctacgg

SEQ ID NO: 265791 - DNA, 632 bp, Homo sapiens
  misc_feature: GYAE6OF02H92OY.34.26.C04.1.454.CMB.1.raw
  modified_base (176)..(176): a, c, t, g, unknown or other
  misc_feature (176)..(176): n is a, c, g, or t
  modified_base (194)..(194): a, c, t, g, unknown or other
  misc_feature (194)..(194): n is a, c, g, or t
  modified_base (283)..(283): a, c, t, g, unknown or other
  misc_feature (283)..(283): n is a, c, g, or t
  modified_base (374)..(374): a, c, t, g, unknown or other
  misc_feature (374)..(374): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagnggtgtccagtgtcaggtncagcgtggtggagtcgtggggggagcgtcggcccaggccgtgggaccgtccgtgacgactctccgtgtgacagcgtctggcttcacttnacgtgtcatgggctatgcacgtcgggtcccgcaggcctccgaggaccgaaggggctagggacggtggggtcgacgtagttatagtaggtanggaagtacgggaaagtttacgntaaaaacgttntaagcggtacaaggtacctcggtagggtaaacgggtcccgtaacttccgaccgttaccgtacgaacggacgaacctaaaccgacctaaacgaactaccgacgtgtactacgtactaacgaactacgaaccgtaccgtacgacggagtaaccgaccggtacgaccggacgtcgttaactacgttacgtaccgtgtacggacgtaggacgacgactacgacctacgg

SEQ ID NO: 265792 - DNA, 588 bp, Homo sapiens
  misc_feature: GYAE6OF02FUN3H.34.26.C04.1.454.CMB.1.raw
  modified_base (347)..(347): a, c, t, g, unknown or other
  misc_feature (347)..(347): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccctcgttgcttcttttaagaggtgtccagtgtcaggtgcagctggtggagtcgttgggggagcgtggccccagccgtgggactcccgtgacgactctcctgtgcagcgtctggattcaccttcagtagtcatggcatgcacgtgggtccgccaggctccaggcgaaggggctgggagtggggtcggntaggttatagtggtatggataggaagtagtactaatactagtgacacgtactcggtaggaacgggccgtagttcacccgtcctccgagacgacaactcccaaagaaccacgactgtactacgtacgactaaacgtcgtaaccacgacctagacggacgtaccggaacggtacgaccggacgtacgtagttaacttaccgttagtacggacggacggacggtaacgacgacgacctaaccgg

SEQ ID NO: 265793 - DNA, 643 bp, Homo sapiens
  misc_feature: GYAE6OF02JRAI4.34.26.C04.1.454.CMB.1.raw
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagcgtggtggagtcgtgggggagcgtggcccagcctgggactccctgagactctcctgtgcagcgtctaggacttcaccttcagtagtcatggacatcgcgacgtggtccgccgaggcctccgaaggcgaaggggtctagggaggtcgggtcggacgtagttagtgtagggttatggtagtgggtaaagtacgtcgtaaaatcgttaancganaacggtacctcggtaggacgggtctacgtacctaccggtctaccgaggtacgaacctaacgtacccaaagaaccgacgtcgttacaacgttacacgaactaaacgtaccgaacctacgtaccgtacggaacggaacgaccggtaacggaccgtacggtacctacggttagttaaccgttacgtacgggttagaaccggagaaccggtaacgtaccgaacggtaccctaacgg

SEQ ID NO: 265794 - DNA, 641 bp, Homo sapiens
  misc_feature: GYAE6OF02HYG78.34.26.C04.1.454.CMB.1.raw
  modified_base (285)..(285): a, c, t, g, unknown or other
  misc_feature (285)..(285): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (605)..(605): a, c, t, g, unknown or other
  misc_feature (605)..(605): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagtccgtgggaccgtcctgacgactcctcctgcgcgagcgtcgtggacttccaccttnagtagtcagtggcatgcacgtggcccnccaggcctccgaaggcgaaggggctgggagtggggcgatagttangtggtangagttaggaacgtagtcaaatagtatggactaacggtacctcgggaggtaaacgggaccgtagttacccgacccgttcaacccggaagaacgaaagaaacccgttaacccgaaaagtaaaccgacgtacgtgtaaactcgttaacgaaactaaacaccgaaccgaagttacccgtaggaaacgtaaccggaccggaaacgggaccgtaccggtaactgttaacggtacttaacggttacgnggaacgaggaacggaacgactaccgtacctaaccgg

SEQ ID NO: 265795 - DNA, 702 bp, Homo sapiens
  misc_feature: GYAE6OF02GISL5.34.26.C04.1.454.CMB.1.raw
  modified_base (261)..(261): a, c, t, g, unknown or other
  misc_feature (261)..(261): n is a, c, g, or t
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggttgtccagtgtcgaggtgcagctggtggagtcgtgggggagcgtcggcccagccgtgggacctccctgagctctcctgtncagcgtcnggattccacttcagttagtcatggacagtcgctaccgtggggtcccnccgagggtcctccgaagggccgaaagggggtcctaggggaggttggggtaggactaggtttaatagtgggttatgagttacggaagttacgtactaaaagttactagtacgaccgtaacgtaccgtcgggtaacggaacgggtcccgtaacgtttcccgaacccgttcctacccgaaaggaacgaaacctaaaccgtaccccgaaaagaaccctacggtacttaaggttaactcgtaacgaacctaaacgttcgaacccgtagtcccgtaagaacggtaaccgaccgggtaaaccggaccgtaaccgggacgttaagttacggtttaaccttacggttcggtacggaccggaagggtacggaaccgaccgaaccgcccgtaaccgg

SEQ ID NO: 265796 - DNA, 616 bp, Homo sapiens
  misc_feature: GYAE6OF02GE353.34.26.C04.1.454.CMB.1.raw
  modified_base (309)..(309): a, c, t, g, unknown or other
  misc_feature (309)..(309): n is a, c, g, or t
  modified_base (405)..(405): a, c, t, g, unknown or other
  misc_feature (405)..(405): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtcgtgggggaggcgtggcccagcctgggacgtccctgagactctcctgtgcagcgtctggattccaccttcagtagtcatggctatcgacacgtggggtcccnccgaggcctccgaggcgaaagggggcctagggaggtggggtcggcgtaggttatagttggtagtggtagtagggaagtagtacaattactatcganacgaccgtccgtaggaagggccgtaagttccgacccgtcgtccgtaaggaacgaacctaacgtacccaaacgaaccacgctacgtaactccgtaggactaaagtcgaaccgtaacgccgtaaggacggacggaccgaacggaccgtacggacgttaagtacgttaagtccgttagcggacgaggtaacggaggacctaacggcctaaccgg

SEQ ID NO: 265797 - DNA, 612 bp, Homo sapiens
  misc_feature: GYAE6OF02JHQLM.34.26.C04.1.454.CMB.1.raw
  modified_base (211)..(211): a, c, t, g, unknown or other
  misc_feature (211)..(211): n is a, c, g, or t
tcagtacacgtgatcacgaccggtgctcgatttagtctagcgactttgggtttgggggctgggagaggagcccagcactagaggtcggcggtgtttccattcggttatcagcactgaacgacagaggactcaccatggagtttgggctgagctgggttttcctcgttgctctttaagaggtcgtcagtgtcaggtgcagctggtgagtcgngggggagcgtggcccagcctgggacgtccctgagactctcctgtgcagcgtctggattcaccttgaagtaggtcagtggcatgcacgtgggtccgccgaggctaccgaggcgaaggggctaggagtgggtggcagttatagtggtatgagtggaagtagtacaatacgtatgacaggtacctacggtacggaacgggccgtagttccgaccgtctcgaaggtagaaccaaatacccgtaaagaccaacgtcgtaagttactacgttgaactaacgtacgtacccgaagacccgttagaacggtacgaccggaacggaaccgaccggtagtacgtacggttaacttacgttggtaccggacgtaacggaggaacgtaccgaacggtacccgtaccgtacggg

SEQ ID NO: 265798 - DNA, 553 bp, Homo sapiens
  misc_feature: GYAE6OF02I4JTE.34.26.C04.1.454.CMB.1.raw
  modified_base (303)..(303): a, c, t, g, unknown or other
  misc_feature (303)..(303): n is a, c, g, or t
  modified_base (420)..(420): a, c, t, g, unknown or other
  misc_feature (420)..(420): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtcctgagactctcctgtgcagcgtctggattcaccttcagtagtcatggcatgcacgtgggtccnccaggcctcgaggcaaggggctagggaggtggggtggctaaggttatagtgggtatgagtgggaagtgtacaaatactagtgacagtactccgtaggaaggccgtattcgaccgtcnccgagacgacaactcccgaaacgaacacgctagtactctgacaatcgaccacgcaggacgacgtacgacggacgacggtactagtacgttacttacgtgtaggtacgaggacgtaacgacgtacgcctaacgg

SEQ ID NO: 265799 - DNA, 674 bp, Homo sapiens
  misc_feature: GYAE6OF02IDS72.34.26.C04.1.454.CMB.1.raw
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (467)..(467): a, c, t, g, unknown or other
  misc_feature (467)..(467): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgcttcttttaagnggtgtccagtgtcaggtgcagctgggtggagtcgtggggggagcgtggcccagccgtgggacctcctgagacctctcctgngcagtcgtactggacttccaccttcagtagtcatggcagtgcctacggtcggggtcccaccgaggcctaccgagggccgaaggggtctgggtacggtggggtcggacttagttataggtcggtatgagtgggtaaagtcgtacctaattacgtgtggacgtaacggtccgttacgggtggaacgggtacctacgtccgtacccggtacncccgaaggacgtaaccaacgtacccgaaacgtaaaccgacgtacttacggtaacttccgtacgtaacgtaaacgtccgaacccgtacgtaccgtaacgacggtaccgaaccggacgaaccgggccgttaacgtcgttaacggtttaaacttacggtaggtaacggaccggtaggtaaccggaacgtacgtacccgggaccctaacgg

SEQ ID NO: 265800 - DNA, 557 bp, Homo sapiens
  misc_feature: GYAE6OF02HM6MO.34.26.C04.1.454.CMB.1.raw
  modified_base (177)..(177): a, c, t, g, unknown or other
  misc_feature (177)..(177): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtcggcccagcccgtgggacctccctgagacctctctgtcgcagcgtctggacttcaccttcagtntcatggcatgcacgtcgggccncaggcctcgaggcaggggctgggagtggggtgcagtatatggatgagtaggaagtgtacaattactatgaccagtaccgtcggtaggaacgggtcctagtcccgaccgttctaccgagaacgaccaactacccaagaaccgtacgacgttagtactcgtagacctaaagtcgaccgtagtcctagacgacgaccggagaccgacggtacctatcgttactagtcgagcgagacgtacgactagcctacgg

SEQ ID NO: 265801 - DNA, 663 bp, Homo sapiens
  misc_feature: GYAE6OF02JFJNG.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacctccctgacgtactctccgtgtgcagcgtctggacttccaccttcagtcgtcagtggcatgctacgtggactccgtcgacggtcctaccggagggacgaagggggtcgtagggtacgggtgggtgactaaggtttataggtggtaatggagttagggaagttacgtactaaagttactagtcgacgtaagtaccgtacggtacggaacgggtacccgtagttcccgtaaccgtccgtaccgtaagaccgaactaaacctacccgaaacgtaaccacgtacttagtaacttcgtacgaactaaagttccgaaccgtacgtaccgtaggaacgaccggtaaccggacgaaccggtaccggtacgttaaggttacgttaacgttaaccgtggtacggacggtaacggaggaaccggtacgacgtacccg

SEQ ID NO: 265802 - DNA, 651 bp, Homo sapiens
  misc_feature: GYAE6OF02HEGD2.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggacttcaccttcagtagtcatggcatgcacgtgggccgccgaggtctccgagggcgaacgggggtctaggggaggttgggggtggtcgtaggttttatagtcgggtatggaaggttgggtaaaggttaggtactaaattaacgttatacggacgaacgttacccgtccggtagggtaaccggggccggtaacgtttacccgaacccggttactaccggaacggtacgaaccgaaactaccccgaaaacgaaaccgtaccgtacttacggtacttcctacgaactaaacgtcgaaacccacgtcccgtaggaacgacggaccgacggacgacggacgttagtacgttattacgtggttaggacgacggtagaggacgacgccaccg

SEQ ID NO: 265803 - DNA, 755 bp, Homo sapiens
  misc_feature: GYAE6OF02IL85O.34.26.C04.1.454.CMB.1.raw
  modified_base (416)..(416): a, c, t, g, unknown or other
  misc_feature (416)..(416): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagttgtcaggtgcagcgtggtggagtcgtgggggaggcgtggcccagcctggggacctccctgacgtcctctcctggtgcgagcgtctggtattccacccttcagttacgtcagttcggactagttgaccgtacgttccggggtcccgccgtacgggtcctacccggagggtccgaagggggtcctggggacggttggggttaggcttaaggtttaataggttgggttaanggtagttagggaaacgttacggtactaaaattcgtaagtccgactaaggtcccgttaccggtagggaaaccgggacccgttaacttacccggtacccgttaccgtacccgaacggtaaccgaacccgtaaaccttaaccccgaaaacggaaacccgtaccggcgttacgtaacgttaccgtacgtaaacctaaacggtacctaacccgacgtaccgtacggaaccggtacgacccggaacggaccgtaaccggtacgttaacgttaggtttaacgtttaccggtaggtaccggtaacggtaggtaaaccggaacggtaccgtacgtaaccccgtaacgg

SEQ ID NO: 265804 - DNA, 653 bp, Homo sapiens
  misc_feature: GYAE6OF02FP83X.34.26.C04.1.454.CMB.1.raw
  modified_base (257)..(257): a, c, t, g, unknown or other
  misc_feature (257)..(257): n is a, c, g, or t
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggactccctgagactctcctgtncagcgtctggattccacttcagtagtcagtggcatcgcacgtcgggtcccnccgaggcctccggaggccgaaggggtcctgggacggttggggtcgacgtagtttagtacgtgggttaatggagttacgggaaagttacgtataaagttacgtaatcgacgtaacgtcgtaccggtaggaacgggtccgtacttcgtacccgtcgtaccgaggacgtaacctaaactaccccgaaaggtaaccacgtacgtacgttactactacgtaacaaagtaccgaacgtacgtacctacggaggacccgaaccggtaggaacccgtacggtacgttaacggttacgttaacgttaacgtacggtaggtacggacgtacggaacggtacgacgtccctaacgg

SEQ ID NO: 265805 - DNA, 817 bp, Homo sapiens
  misc_feature: GYAE6OF02G8799.34.26.C04.1.454.CMB.1.raw
  modified_base (178)..(178): a, c, t, g, unknown or other
  misc_feature (178)..(178): n is a, c, g, or t
  modified_base (279)..(279): a, c, t, g, unknown or other
  misc_feature (279)..(279): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtggcccagccgtgggactcccgtgacgctctcctgtgcagcgtctggattccaccttnagttagtcagtggcagtcgctacgtcgggtcccgccgagggccctccgagggaccggaagggggtcctaggggtagggttcgggggtcgggtacgtaacggtttaagttagtacgggttattaggtagtttagggaaaaggttacgtaaccgtaaaattacttaagtacgtaccgtaacggtacccgttaccgggtacgggaaacggggtaccccgttaagttaccccgtacccggttacccgtaacccggtaaggtaaaccggtaaaccctaaaaccgttaaaccccccggaaaaaggtaaaccccggtaaccggtaccgtttaacggtaaccgtttaccgtaaccgaaaccgttaaaaccgtccggtaaacccgaacggttcccgttaacgggaaacggtaaccgggaacccggggtaacggaacccggaccggttaaccgttaaggtttacgttaaaccgtttaccgggttgggtaaccggaacggtaacggggaacgtaaccgggtaaccgaacccggtaccccgttaaccggg

SEQ ID NO: 265806 - DNA, 643 bp, Homo sapiens
  misc_feature: GYAE6OF02IFTMK.34.26.C04.1.454.CMB.1.raw
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtggggactcccgtgacgactctccgtgtcgcagcgtctggacttcaccttcagtagtcatggcatcgcacgttcggggtccnccgaggcctccgaggcgaaggggtctgggagtggggtgactaggttanagtggtatggactaggtaacgtaagtcaaattactagtcgacagtacctcggtaggaacgggtcctaagttccgtaccgtactaccgaaggaacgaaccaaacgtaacccgaaagaaccgtaccgtatagtaacttacgtacgaacaaagtccggaacccgtacgtaccgtaggaacggaacggtaccggaacggtaccgtaacggtaccttaagttaccgttaacttaccggtagtacgggacgaagtaacgggaacaaccggacccgtaccgtaaccgg

SEQ ID NO: 265807 - DNA, 673 bp, Homo sapiens
  misc_feature: GYAE6OF02JBDAQ.34.26.C04.1.454.CMB.1.raw
  modified_base (309)..(309): a, c, t, g, unknown or other
  misc_feature (309)..(309): n is a, c, g, or t
  modified_base (571)..(571): a, c, t, g, unknown or other
  misc_feature (571)..(571): n is a, c, g, or t
tcagtacacgtgatcacgaccggtgctcgatttagtctagcgactttgggtttggggtcgtgggaggaggagcccagcactagaggtcggcggtgtttccattcggtgatcagcactgaacacagaggactcaccatggagtttgggctgagctgggtttcctcgttgctcttttaagaggtgtccagtcgtgacgggtgcaggctggttgggaggttcgtggggggaggtcggtcgggccctaggccttggggaaccgtccctgagctcctccgtgtgcagcgtctggtacttcaccttcagtacgtnacgtggcatcggccacgtcgggttccgccgtacggcttccccgaagggcgaaagggggtcctagggcgggttgggtcgggactacgttagtagtcgggtaatgaaggtaggaaggtttagaactaatcgtaagcgtcgagtaccgtccggtaggacgggccgtattcccgaaccgttccgtcgacgacgtaactactaccgtaacaaacgccgttataacgtacttacgtacggtactaaacgtccgaaaccgacggtcccnggtaaaccggagccggtaaggtaccgacggtcccgttaagttaccgttaacgtaacgttggttacggtaacacgggaacgtaacgacggacgacccgtaacg

SEQ ID NO: 265808 - DNA, 593 bp, Homo sapiens
  misc_feature: GYAE6OF02ICYKE.34.26.C04.1.454.CMB.1.raw
  modified_base (474)..(474): a, c, t, g, unknown or other
  misc_feature (474)..(474): n is a, c, g, or t
  modified_base (571)..(571): a, c, t, g, unknown or other
  misc_feature (571)..(571): n is a, c, g, or t
tcagtacacgtgatcacgaccggtgctcgatttagtctagcgactttgggtttggggctggggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgacgacctctccgtgtgcagtcgtctggacttcaccttcagtagtcatggcagtcgcacgtcgggtaccgcgacggtcctccgaggcgaaggggctgggacgtggggtgactagttatagtaggtatggaatggaagttagactaagtactagtcgacaagtaccgtccggtaggaacgggtccgtagttccaccgtactaccgagacgaacctaacgtaccaagaaccncgtactagtaactcgtacgtacgaaacgtcgaaccgacgtaccgtagacggaacgaccgaacggacgacggacgttagtagtaacttacgtgacggngacgaggacgacacgacctacg

SEQ ID NO: 265809 - DNA, 641 bp, Homo sapiens
  misc_feature: GYAE6OF02IZXGN.34.26.C04.1.454.CMB.1.raw
  modified_base (590)..(590): a, c, t, g, unknown or other
  misc_feature (590)..(590): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctgacgactcctccgtgtgcagcgtcgtggacttccaccttcagtcgtcagtggacatcgcacgtcgggtccgccgaggcctccgagggccgaaggggctgggaggtggggtggcgtagttatagtggtatggagtaggaagttagtacaaattactaagtcgacgtaagtacccgttaccggtaacgggaacggggtaccgtaacgtttacccgtacccggttcctacccgaaagtaaccggaaacctaaaccgtaccccgaaagaaacccgtacgtaccgttatactccgtaagaactaaacgtcgaaccgagtaccgtagaacggacgaccgacgacgaccggtntaacgttagtacgttacgtggtagacggaggaggtacgacgcgacctacgg

SEQ ID NO: 265810 - DNA, 560 bp, Homo sapiens
  misc_feature: GYAE6OF02HYMIA.34.26.C04.1.454.CMB.1.raw
  modified_base (280)..(280): a, c, t, g, unknown or other
  misc_feature (280)..(280): n is a, c, g, or t
  modified_base (537)..(537): a, c, t, g, unknown or other
  misc_feature (537)..(537): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggacgtccctgacgactctcctgtgcagcgtctggattccaccttnagtagtcatggcatgcacgtgggtccgcgaggcctacgaggcaaggggctaggaggtgggtggcgtagttaatgtggtatgagtggaagtagtacaaagttactaatgacagtactaccggtaggaacgggtccgattccgaaccgttctacccaggaacaaccaactacccaaagaaccacgactagtactcgtagacaaatcgaaccagcctaggaagacggaccgaggaccacggataagtagttaagtcgtgngacgaggagagacgacgctaacg

SEQ ID NO: 265811 - DNA, 736 bp, Homo sapiens
  misc_feature: GYAE6OF02G1G08.34.26.C04.1.454.CMB.1.raw
  modified_base (264)..(264): a, c, t, g, unknown or other
  misc_feature (264)..(264): n is a, c, g, or t
  modified_base (393)..(393): a, c, t, g, unknown or other
  misc_feature (393)..(393): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgctcttttaagaggtgtccagtgtcaggtgcagctgggtggagtcgtgggggagcgtgcccaggcctgggacctcctgagctctccgtgtgacagcgtcnggtatctaccttcagtacgtcagtggctagtcgctacgtcgggtcccgccgtacggccttcccgaagggtccgaaagggggtccagggtacggttgggggcgaccgtaagtttaagtacgtgggttaancggaagtagggtaaacggtagtacctaaagttactagtacggacgaacgtaccgtcggtaacggaaacggggtccgtaacgtttcccgaaccggttccgtaccgaaggaaacgtaacccgtaaacttaccccgaaaaggaaccctaacgggtctttaacgtcttaccgtaacgtaacctaaacgtaccgtaacccggtacgaccggttaaagaacggaccgggaacccggttaaaggacccgggtaaccggtaacgttacggtaaggtttaaacctttacgggtacggttaaccggcggtaaacggaacgggaccttaacgggacccgtaacgtaaccccggg

SEQ ID NO: 265812 - DNA, 660 bp, Homo sapiens
  misc_feature: GYAE6OF02IVIB1.34.26.C04.1.454.CMB.1.raw
  modified_base (177)..(177): a, c, t, g, unknown or other
  misc_feature (177)..(177): n is a, c, g, or t
  modified_base (324)..(324): a, c, t, g, unknown or other
  misc_feature (324)..(324): n is a, c, g, or t
  modified_base (373)..(373): a, c, t, g, unknown or other
  misc_feature (373)..(373): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagcgtggtggagttcggtggggggaggcggtggcccaggcccgtgggaccgttccctggacgaccttctcctggtgcgagcgttctggattccaccttcagttatcatggctatgcacgtgggtcccnccgaggcctccgaggcgaaggggctagggaggtggggtgactaggttanagttggtatgaagttaggaagttagtacaaattactatggacctagaccgtaccggtaggaacggggtctaacttccggaaccgttacgaccgtaaggaactaaccaaacctaacccgaaagaaaccgtacgtaccgttagtacgtccgttaacgactaaacgtacgaacccgtacgtcccgtacggtacggaacgtacgggaacgacccggtaacgtacgttaagtcgtttaacgttacggttggtacggtacggaacgtcgaacggacctaccggacctaaccgg

SEQ ID NO: 265813 - DNA, 723 bp, Homo sapiens
  misc_feature: GYAE6OF02GIF0S.34.26.C04.1.454.CMB.1.raw
  modified_base (217)..(217): a, c, t, g, unknown or other
  misc_feature (217)..(217): n is a, c, g, or t
  modified_base (384)..(384): a, c, t, g, unknown or other
  misc_feature (384)..(384): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggngcggtggcccagccgtgggaccttcccgtggacgtactcctcctggtcgcgaggtccgtctggactttccaccttcagtagtcagtggcattgacctacgtcgggcccgccgaggcctaccgagggcgaaggggctgggaggtggggtgctagttatagtggttagngtaagtagggtaagttagtactaagttactaagtgaccaaggtccgtaccgggtaaggaccggggtaccgttacgttacccgacccgttaccgtaccgacgtaacgaaccctaaacgtaacccgaaacgaaccgaccgtcgtagtttactaccgtaacgtaaccgtaaacgtaccgaacccgtaacgtccgttaacggaacggtaaccgggaccgggaaccgggaaccgtaccgggtaacgtttaacggttttaaccgttaaccggtttacggttacgggtaaggtacccgggtaaaggtaaccggaaacgggtaccgacccggtaccccgtaaccggg

SEQ ID NO: 265814 - DNA, 637 bp, Homo sapiens
  misc_feature: GYAE6OF02GZCIB.34.26.C04.1.454.CMB.1.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggactccctgagactctcctgtgcagcgtctggattccaccttnagtagtcagtggcagtgcacgttcgggccnccgaggcctccgaggcgaaggggctgggagtggggtacggactaggtttatagtgggtatggagtagggaaagttagtacgtaaatactagtcgactaacgtaccgtccggtaggaacgggtccgtacttaccgacccgttcgtacccgagtaacgaccaactacccgaaacgtaaccgaccgtacgttacgtactccgaagtacctacgaccgaccgtacgtccgtaacggacggaccggacgggaaccgtacggacgtacgtaagttacgttaacgtacgttaggtacgaacgggtaaggtaaccgacggaccgtaccgacccgtaacgg

SEQ ID NO: 265815 - DNA, 750 bp, Homo sapiens
  misc_feature: GYAE6OF02H749C.34.26.C04.1.454.CMB.1.raw
  modified_base (164)..(164): a, c, t, g, unknown or other
  misc_feature (164)..(164): n is a, c, g, or t
  modified_base (330)..(330): a, c, t, g, unknown or other
  misc_feature (330)..(330): n is a, c, g, or t
tcagtacacgtgatcacgaccggtgctcgatttagtctagcgactttgggtttgggtcgtggaggaggagcccagcactagaggtcggcggtgttccattcggtgatcagcactgaacacagaggactcaccaatggagtttgggctgagcgtgggtttttccncgtttgccttacgttttaagaggttgtccaggtgtcgaggtgctagcgtggtacggagtcgtggggggagcgtaggcccaggtcccgtgggaacgtccctggacgactcctccgtgtcgacgagtccgtacgtggatccacctttcgagttagtcagtgggtaacngtacgcctaacggtcgggtcccccgaacgacgggtcctacccggaagggtacccggaaaggggtcccgtaaggggtacgggttgggggcggcttaagggttaattggttaagggattccgaagtagggaaaacccggtaggttcaaaaagtttccgtaagtcggacgtaaccggaaccgttccggaagggtaacgggaaccccgttaacgttacgaccccggttagtcccaaacggtaacgggaaaccctaaaccgttaacccgaaaacggaacgtacccggtacgttaacgacgttaacgttccggaaactaaactacggaccgtaccgacgttacggaaaggccgaaccggacgaaccgttccggaactaatcgtagtaaaccgtgcggtacgagaacgacgtaacgcgacgtacccg

SEQ ID NO: 265816 - DNA, 662 bp, Homo sapiens
  misc_feature: GYAE6OF02IDENP.34.26.C04.1.454.CMB.1.raw
  modified_base (375)..(375): a, c, t, g, unknown or other
  misc_feature (375)..(375): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctgttgctctttaagaggtgtccagtgtcaggtgcagctggtggagtcgtgggggagcgtggcccagccgtggggactcctaggacgacttcgtccgtggtcgcagccgttcgtggaactttcacctttcgagttacgttcaagtcggctagtcggcctaacgtcggggtccaccgaggcctccgagggaccgaagggggtctagggtagttcgggnggacctaggttatacgtgggtatggatagggaagtagtacaaagtactagcgactaggacctcggtagaacgggcctattaccgacgttacgacgaaggacgaaacaaccttaccgaaaacgtaaccgacgtacgtgtacctacgtacgaacttaaacggacgtaaccgacgtccgtaaggaacgtaaccggacgtaaaccggacgtaccggtacgtaaacgtttacgtacgttaaccggtgtacggtacggaaacggtaacggtaaccgacgtaccgaccgtaacg

SEQ ID NO: 265817 - DNA, 627 bp, Homo sapiens
  misc_feature: GYAE6OF02JJJ22.34.26.C04.1.454.CMB.1.raw
  modified_base (178)..(178): a, c, t, g, unknown or other
  misc_feature (178)..(178): n is a, c, g, or t
  modified_base (316)..(316): a, c, t, g, unknown or other
  misc_feature (316)..(316): n is a, c, g, or t
  modified_base (471)..(471): a, c, t, g, unknown or other
  misc_feature (471)..(471): n is a, c, g, or t
  modified_base (592)..(592): a, c, t, g, unknown or other
  misc_feature (592)..(592): n is a, c, g, or t
  modified_base (611)..(611): a, c, t, g, unknown or other
  misc_feature (611)..(611): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctgggtggagtcgtgggggagcgtggcccagccgtgggaccgtcctggacgctctcctgtgcagcgtctggtacttccaccttcagtacgtctagtggcatcgcgacgtcgggtccnccgaggcctccgaggcgaaggggtctagggacggtggggtcgctaggttagtagtcggtaatgaacgtgggtaaacgttcgtacgtaaattacgtatcgtacgaacggttaccgtccggtagggtaacgggtacctacgtttccgacccgttacnccgaaggtaccgaactaactaccgaaagactacgtcttagactctaaggactaaacgacgtaccgacgtccaaggtacgacggaccgaggtaccgacggtactaacgttagtacgttacgnggtacgacggtagacgganaaccgcgtactaccgg

SEQ ID NO: 265818 - DNA, 635 bp, Homo sapiens
  misc_feature: GYAE6OF02IL0GZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctctttaagaggtgtccagtgtcaggtgcagctggtggagtcgtgggggagcgtggcccagccgtgggactcctggacgctctcctgtgcagcgtctggattcacttcagtagtcagtggactatgctacgttcgggcccgcaggccaccgaggccgtaaggggctagggcgtggggtcgacgtagttagtagtggtatggaatcgggtaaatacgtactaaagttcgtaatgactacgtaacgtcggtaggaacgggtcctacgttaccgaccgttctacgacgagtaaaccaacttaacccgaaagaaccgacgaccgtagaccttacgtacgaactaaacgtccgaaccagtccgttaaggaacgaacgggacccggaacgaaccgtacggtactttaacggtacgttaacttacccggtaaggtaccggacggaaggaccggaacgacgtaacggcccttaaacgg

SEQ ID NO: 265819 - DNA, 780 bp, Homo sapiens
  misc_feature: GYAE6OF02HRCQN.34.26.C04.1.454.CMB.1.raw
  modified_base (176)..(176): a, c, t, g, unknown or other
  misc_feature (176)..(176): n is a, c, g, or t
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgctcttttaagnggtgtccagtgtcaggtgcagtctggtggagtcgtgggggagcggtggcccagcccgtgggacctcccgtgagtacctctcctggtgcgaggcgtctggactttccncctttcaggttacgtcctagtcgggactagtcggcccgtaccggttccggggtccccggaccgaacgggtccctaccggaagggccggtaaacgggggtctagggggtacgggttgggggtcggaccgttaaggtttataaggttgggttaataggtacgttaagggtaaagttaacgtactaaaacgtttaaccgagtacggaccgtaacggtaccccgttaccgggtaacggggtaaaccggggtacccgtaccgtttaacccgtacccggttcccgttaacccggaaggaaccgtaaacctaaacccgtaaacccgtaaaacggtaacccgtaacgtcccgtttacggttaacctcgtaacgtaaccgtaaaaccgtccggaaccctagtccgtaacggaacgtacggaccggaagggtacccgaccggtatacggttaagttacgttacggttacggcgacgggagacggtaacggaaccgacgtcccgaacg

SEQ ID NO: 265820 - DNA, 579 bp, Homo sapiens
  misc_feature: GYAE6OF02HAYL8.34.26.C04.1.454.CMB.1.raw
  modified_base (265)..(265): a, c, t, g, unknown or other
  misc_feature (265)..(265): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggcccagcctgggacctccctgagctctcctgtgcagcgtcgnggattccaccttcagtagtcatggcatgcacgtggtcccgcaggctccgaggcgaaggggctggaggtggggtgcgtagttatagtggtatgagtggaagtagtctaatactagtgctagacgtccggaggaacggtccgtattccgaccgttctaccgagaacgacaacctaccgaaacgaacacgtcctaggtactcgtagaacctaaagtccgaaccacggtaccgtaggaacggacgaccgggaacggaccgacccgattaacgtacgttacttaacgtgtaggacgtagagacgtacgacgctaaccgg

SEQ ID NO: 265821 - DNA, 599 bp, Homo sapiens
  misc_feature: GYAE6OF02JGPT0.34.26.C04.1.454.CMB.1.raw
  modified_base (338)..(338): a, c, t, g, unknown or other
  misc_feature (338)..(338): n is a, c, g, or t
  modified_base (377)..(377): a, c, t, g, unknown or other
  misc_feature (377)..(377): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggactccctgagactctcctgtgacagcgtctggattccaccttcagtagtcatggctatgcactgggtccgccaggcctccaggcaaggggctggagtggggngcagttatagtggtatgagtggaagtgtacaatacgtangacacgtacgtccgtggaacgggccgtacgttacgaccggttccaccgttaggacgtacaacgttacccaaagtaaccacggtactagtactacgtagacaaacgtcgaaccacgccttaggaacgtacggaccggaaggtaccgtaacgggttacgttaagttaacgttacgtacggtacggtacggaaggtaacgaccggtaacaccgacccacgtacgg

SEQ ID NO: 265822 - DNA, 522 bp, Homo sapiens
  misc_feature: GYAE6OF02F2UCX.34.26.C04.1.454.CMB.1.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (351)..(351): a, c, t, g, unknown or other
  misc_feature (351)..(351): n is a, c, g, or t
  modified_base (383)..(383): a, c, t, g, unknown or other
  misc_feature (383)..(383): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagctctcctgtncagcttcnggattcaccttcagtagtcagtggctatgcacgttcgggtaccgccaggcctccgaggccgaaggggctagggagtggggtgcagttanagtggtatgagtggaacgtagtacaatactangcagctcgagacggcattcgaccgtntcagacgacaanaccgaanacacgntgtatctacganaatcgaccagtccgagacgcgacgagacacggctaagtcgtattcgtgtcgacgtaagagagacgacgaccctacg

SEQ ID NO: 265823 - DNA, 591 bp, Homo sapiens
  misc_feature: GYAE6OF02GG1YW.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggcccagcctgggaccgtccctgagactctcctgtgcagcgtctggattcaccttcagtagtcatggcatgcacgtggggtcccnccgaggcctccgagggccaaggggctgggagtggggtggcagttatagtggtatgatgggaagtgtacaaatactagtgacagtacctcgtaggaacgggccgtattccgaccgtctaccgagtacgaactaacgtacccaaagaaccacgctagtatccgtgaaccaaagtcgaacctacgacccgtagaacggagacccggaaggaccacggtactaagtacgttaacgttaactggttacgacggtaaggtaacggaacgacggacgtacccgtaaccgg

SEQ ID NO: 265824 - DNA, 712 bp, Homo sapiens
  misc_feature: GYAE6OF02H6UCR.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgcttcttttaaggaggtgtccagtgtcaggtgcagctgggtggagtcggtggggggaggcggtcgggccccaggccccgtggggacctcccgtaggacgaccttcctccgtgtcgcaggcgtcgtggacttccactttcagtagtcagtgcatcgccacgtcgggtccccgccgaggtccctaccgagggccgaaagggggctaggggacggtgggggtgacgtaggtttaatggttagggtatggaagttacgggaaaggttaagtacgtaaattacgtagtacgacctagtaccgttccggagggtaaccgggtaccgtacgttacccgacccgttacgtacccgtaaggtacgtaaacctaaaccgtaacccgaaaagtaaaccgaccgtacgttacgttaactacggtaccgaaacgtaacgtacgaacccgacgtacccgtaggaacgaaccgggacccggaacggtacccgacggtacgtagtaacgttacgttaccgtgtaggcggtaacgaacggtacggaccgacgtcccgtaaccgg

SEQ ID NO: 265825 - DNA, 644 bp, Homo sapiens
  misc_feature: GYAE6OF02II80O.34.26.C04.1.454.CMB.1.raw
  modified_base (308)..(308): a, c, t, g, unknown or other
  misc_feature (308)..(308): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtcgtgggggagcgtcggccagccgtgggacctccctgagactctcctgtgcagcgtctggattccaccttcagtagtcagtggcatgctacgtcgggtccnccgaggctcccgagggccgaaggggtcctggggtaggtgggggtcgctaggtttaagtagtgggtataggtaatgggtaaagttagttacaaattactagtagactaagaccgtccggtagggaacgggtccgtactaccgtaccgtactaccgaagaacgaccaactacccgaaagaaccgtaccgctacgtactacgtagaacctaataccggaacctacgtcccgtaggacggtaacgacccggtaacgggaccgccggtacgtaagttacgttaacgttaacgtaggtacggacgtaaggtacggaacggtaacccgagtaccccgtaacgg

SEQ ID NO: 265826 - DNA, 589 bp, Homo sapiens
  misc_feature: GYAE6OF02GXE00.34.26.C04.1.454.CMB.1.raw
  modified_base (304)..(304): a, c, t, g, unknown or other
  misc_feature (304)..(304): n is a, c, g, or t
  modified_base (490)..(490): a, c, t, g, unknown or other
  misc_feature (490)..(490): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgacgactctcctgtgcagcgtctggattcaccttcagtagtcatggcatgcacgtgggtccnccaggcctccgaggcgaagggggctaggggagtggggtcggctaggtttatagtgggtaatgagtgggaagtagtacaaattactatcgacagacctcgtaggaacgggccgattaccaccggtctaccgagacgaacaactacccgaaagaaccacgcttagtatcgtagaccaaagtcgaaccngtcctaggaacgacggaccggaaggaccgacggacgttaagtacggttaacttaacggtgttacggacggtaacggaggaacgacgtacgccctaacgg

SEQ ID NO: 265827 - DNA, 546 bp, Homo sapiens
  misc_feature: GYAE6OF02GQMXJ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggaccgtccctgagactctcctgtgcagcgtctggattcaccttcagtagtcatggcatgcacgtgggtccgcgaggctccgaggcaaggggctggaggtgggtgcagttatagtggtatgagtggaagtagtacaatactatgacagacctcgtagaacggcgattccgaccgtctcagacgactaactcccaaaggaaccacgtactacgtactacgtgactaaagtcgaaccgacgctagacgacgccgaaggacacggtctaagttacgttactacgtagtacgacggagacgagaccgacgacctaccg

SEQ ID NO: 265828 - DNA, 576 bp, Homo sapiens
  misc_feature: GYAE6OF02GGYIW.34.26.C04.1.454.CMB.1.raw
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (382)..(382): a, c, t, g, unknown or other
  misc_feature (382)..(382): n is a, c, g, or t
  modified_base (559)..(559): a, c, t, g, unknown or other
  misc_feature (559)..(559): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccatggagtttgggctgagcggtgtttcgcgtaggcgtcttaagaggngtcagtgtnagtgcagctggngatcgngggggagtcgnggcccagccgttagggacgtccngacgactctccgtgtcgacagcgtntggtacttacaccttgatagcagtgacaagtcgacacgtcgggacctcgacggctccgagcgaagggcttaggcggtggcgacgtatagtanacggtanggtatggtaaacgttatntaaacgttagtataggcctaagtacgtacgtagacggactagttacacgtcacgagtacgaactacgaacaacgaacgactcgtagattcgacgtaacaagtacgaccacacgacggagaacggaccgtaagacgtaacgtactaagtaacttacgtacgtacgacgacgacggaanaacgacgtacgacgacg

SEQ ID NO: 265829 - DNA, 618 bp, Homo sapiens
  misc_feature: GYAE6OF02IDOLW.34.26.C04.1.454.CMB.1.raw
  modified_base (178)..(178): a, c, t, g, unknown or other
  misc_feature (178)..(178): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcgtgcccagccgtgggacctccagacgtacctctccgtgtcncgagcgtcgtggactttcgaccttnagtagtcagtggcagtgccacgtgggtcccgacaggtcctaccgaaggccgaaggggtctgggagtggggtgctagttatggtggtngagtacggtaagtcgtacaatttacagtgacgtgtactcggtaggacggccgttatccgacgtctacgagacgtaactaaccgaccctaaagaacgtccgtactagtacctcgtagtaaccaagtaccgaccgtacgtccgtaacggacggtaaccgaccgggtacggacgtacccgggtattacgtacgttactttacggacggttcggaaggtaacgaggaaccggacacccggtactaacgg

SEQ ID NO: 265830 - DNA, 687 bp, Homo sapiens
  misc_feature: GYAE6OF02IJWRG.34.26.C04.1.454.CMB.1.raw
  modified_base (331)..(331): a, c, t, g, unknown or other
  misc_feature (331)..(331): n is a, c, g, or t
  modified_base (662)..(662): a, c, t, g, unknown or other
  misc_feature (662)..(662): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggcccagccgtgggactcccgtgagactcgtcctgtgcaggcgtcgtaggacttccaccgtttcgagttacgtctactgggacagttcgacctacgttcggggtccccnccggaacggtcctacccgagggccggaacgggggtcgtagggtacgggtcgggggtcggacgttaaggtttaagtaggttaggtacgttagggagttagggaaaccggtaggtacctaaagttacgttagtcggactacgtaccgtaccggtaggaacgggtactacgttacgaccgtactaccgaagtacgaaactacctaccgaacgaacgacgtacgtcgtactcgtacgaacgtaaacgtccgaaccgtacgtccgtaaggacggaccgacgaacggaccacggtaccgtaagtaccgttacttacggtacgtacggcgtaaacggngaacggtaccacggtacccgtacgg

SEQ ID NO: 265831 - DNA, 800 bp, Homo sapiens
  misc_feature: GYAE6OF02HHW4P.34.26.C04.1.454.CMB.1.raw
  modified_base (262)..(262): a, c, t, g, unknown or other
  misc_feature (262)..(262): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtntggtattccgaccttcagttacgtcagtcggcatcgcgacgttcggggtcccgaccgtacggcctacccgagggaccgaagggggtcctaggggacggttcgggggtacggtccgtaaggtttaagtacgtaggggtttaagtaggtaaggttacgggtaaaacggttacgttaaccgtaataaccgttagttacggaccaacgggtacccttaccgggtaagggtaaaccggggtaccgtaccgtttaccggaaccccggtttacccgaaccgtaacgggtaaaccgtaaccgtaaaacccggttaacccccgaaaacggtaaaccctaacccggggtaacttaccggtaaaccgtttccgtaacggtaacccgttaaaacggtacccgttaaacccggacgttaacccccgggtaggaacgggtaaccgacgggtaacgggaccgtaaccgggttcctaaacggttacgttaacgttacccggttaggttacggacgggttacggaacgtacggaaccggacgtacccgtaaccgg

SEQ ID NO: 265832 - DNA, 746 bp, Homo sapiens
  misc_feature: GYAE6OF02IU7CN.34.26.C04.1.454.CMB.1.raw
  modified_base (271)..(271): a, c, t, g, unknown or other
  misc_feature (271)..(271): n is a, c, g, or t
  modified_base (293)..(293): a, c, t, g, unknown or other
  misc_feature (293)..(293): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttggggttttcctcgttgcttcttttaagaggtgtccagtgtcaggtgcagctggtggagtcgtgggggaggcggtggcccgagccgtgggccgtccctggacgacttcctccgtgtcgcnggcgtcgtggacttcgaccttnaggttagtcagttggctagtcggtacctacggttcggggtccccgccgaacgggtccgtaccccgaaggggtaccgaaacgggggtcgtaggggtacgggttggggggtcggtaccgtaaggtttattaacggtggtttaagtggtaacgttaggttaaaacggttacgtaacctaaaagttaccttagacggtacctaacggtaccgttacggtacgggtaaacgggtacccgtaacgtttacccgtaaccccggttcgtaacccgtaacggaaccaacgtaaccgacccgtaaaacgtaaaccgtacgtaccgtttacgtaacgtacgtaacgaacctaaacgtacgaacgtaccggtaccgtagaaccgacggaccgtaacggacgtacggtacgttaagtacggttaattcggttacgtagacggagaaggtacaacgtcggactacgg

SEQ ID NO: 265833 - DNA, 600 bp, Homo sapiens
  misc_feature: GYAE6OF02JL46W.34.26.C04.1.454.CMB.1.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtgcccagcctgggacgtccctgagactctcctgtgcagcgtctggattcacctttnagtgtcatcggcatgcacgttcgggaccnccgtaggttcccaggacgaacgggggctaggggagtggggtggcgagttacgtatgggtaatggaagtgggaaagttagtcaaattacgtaagtgacgaagtaccgtccggtaggaacgggtccgtaattccaaccgttcctaccgaagacgaacctaacacccaaagaaccaccgtagtacgttaactcgtacgactaaacgtcgaaccacgacctggaagacgccggaagaccgacgtatacgttagtactttaggcgttaggagtagacgacgacgacgtaccgaccgtacgg

SEQ ID NO: 265834 - DNA, 814 bp, Homo sapiens
  misc_feature: GYAE6OF02IGY3G.34.26.C04.1.454.CMB.1.raw
  modified_base (162)..(162): a, c, t, g, unknown or other
  misc_feature (162)..(162): n is a, c, g, or t
  modified_base (179)..(179): a, c, t, g, unknown or other
  misc_feature (179)..(179): n is a, c, g, or t
  modified_base (275)..(275): a, c, t, g, unknown or other
  misc_feature (275)..(275): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttccngttgcttcttttaaggnggttctccagtgtcaggtgcagcgtggtggagtcgtggggggacgcgtcggaccctaggccgtgggtaccttcccgagacgtacctctccgtaggngacaggtccgtctggtaccttcctaaccgttcgaagttcgtccgtaagtcgggaccaagttcgtacccgaccgggtttccgggggccccaccgtacgggtccccttaccgggaaaggggtaccccggtaaacggggggtcctaggggggttaaccgggttgggggttccgtaacgttaaggtttacgttaaggtacgggtatacgggtacggttaggttaaaaacgtggtttaaccaaattttacgagtccggacttaacgggtacccgtttacgggtacggaaaccgggttacccggtttaacgttacccggtaaccggtaccgttaccgggaaacgtacccggtaaaacctaaccgttaaaccccgaagtaaacccggtctccggttaataacctacggttacaaccgtaaacgtccgtaaccgaacgcgtaacgggactaacgggaccgtaacgccggttacgtacgttacggtacttacggtagttaccgggtagtaccggaggtaacccggacgtaccgccggaccttaccggg

SEQ ID NO: 265835 - DNA, 706 bp, Homo sapiens
  misc_feature: GYAE6OF02HHL3E.34.26.C04.1.454.CMB.1.raw
  modified_base (674)..(674): a, c, t, g, unknown or other
  misc_feature (674)..(674): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcgttgctcttttaagaggtgtccagtgtcaggtgcagcgtggtggagtcggtgggggacggcggtcggccccaggcccgtggggaccttccccgtgacgaccttcctccgtggtcgcgacggtccgttcgtggtaccttccgaccttcaaggtacgtcagtggccacgtcgacctacggtcgggtacccgaccgacggtcctacccggaggtaccggaacggggtcgttagggcgggttcggggtggtaccgtaagtttacgtagtacgggttagtaggtaacgtaggaaggtttactacgtaaactacgtaagtcgaccgtaacgtaccgtacggtacggaaccgggtaccttacgttaccgtacccgtactaccgagtacgaaaccgtacctaacccgaaacgaaccgcgtaccgttacgtaaccttgtaacgaacttaacgacgacccacgtcgaaggacgaaccgacgaccggtacgaaccgtgttaaccgtaggttactcgttaggngtaccggaagtacgaccgacgaccaccgtacg

SEQ ID NO: 265836 - DNA, 567 bp, Homo sapiens
  misc_feature: GYAE6OF02I8PDR.34.26.C04.1.454.CMB.1.raw
  modified_base (242)..(242): a, c, t, g, unknown or other
  misc_feature (242)..(242): n is a, c, g, or t
  modified_base (306)..(306): a, c, t, g, unknown or other
  misc_feature (306)..(306): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (424)..(424): a, c, t, g, unknown or other
  misc_feature (424)..(424): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagcctgggactcccngagactctcctgtgcagcgtctaggacttccaccttcagtagtcatggcatgcacgtgggtccncaggctcaggcaagggctgggagtgggngntagttatagtggtangagtggaagtgctaaatactagtcgngtaacgcgttcgtaggaggccgtagttccaccgtccgtaccgaaganaaccaactacccgaagaacctccgtatacgtattcagtacaaatcgaacctacgtacgttaagaccggacggacaaccgtacgacttaacgtggttacttacgttggacgacggaagcggtaagaccgacgaccacgttacgg

SEQ ID NO: 265837 - DNA, 827 bp, Homo sapiens
  misc_feature: GYAE6OF02JDJDY.34.26.C04.1.454.CMB.1.raw
  modified_base (161)..(161): a, c, t, g, unknown or other
  misc_feature (161)..(161): n is a, c, g, or t
  modified_base (180)..(180): a, c, t, g, unknown or other
  misc_feature (180)..(180): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccngttgctcttttaagaggtntccagtgtcaggtgcagctgggtggagtcgtgggggagcgtcggcccgagccgtgggaccgttcccgtaggacgaccttccgtccgttggtcggccgtaaggtccggttccgttagggtaactttcctaaccctttaccgaaggtttaacggttacctaaggttcgggccctaagttccggaccgtaaccggttccgggggtaccccgccgtaacgggtccttacccggaagggttccggaaacggggggtcctagggggtaacgggttcggggggtcgtaccgtaaggtttaacgtacgttggggttaacgttggaacgtttagggtaaaacggttacgttaacgtaaacttaaccggtaattacggaaccgtaacgttaccggtacccggtagggtaaaccgggtccgtaaacgtttcccgacccggttacctacccggtaaaggtaacccgtaaccgtaaaccttaacccgaaacgtaaaccgtacccggtacttaggtaccttaccgtaaggaaccttaaacggtcgaaacccggtacgtacccgtaaggaccgtaccggaccggtacggtaccgaggtaccgttacgtagttaccgtagttacggacgtcggaaggtacgacgtacgaccgtacgtaaccgg

SEQ ID NO: 265838 - DNA, 644 bp, Homo sapiens
  misc_feature: GYAE6OF02HGPRN.34.26.C04.1.454.CMB.1.raw
  modified_base (331)..(331): a, c, t, g, unknown or other
  misc_feature (331)..(331): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgacgactctcctgtgcagcgtcgtggacttccacttcagtgtcagtggcatgcacgtcggtccgcgaggctccgagggcgaaggggtcngggaggtcggggtgacgtagttagtgtggtaagtgaaggttaggaaagtacggttactaaagttacctatcgtccaaggtaccgtaccggttaagggaacggggtacgtaacgttccgaccgttctacgaacgaacgtaaccaacgttacccgaaagaaccgccgtacgttaagtcgttacgtacgaaacgtaacgtacgaacctaacggaccgtaggtaacggaacggacccggtaaggaccgaacggtacgttaggtacgttacttaacgttggtacggacggaggtacgaacggaccgagaccctaacgg

SEQ ID NO: 265839 - DNA, 658 bp, Homo sapiens
  misc_feature: GYAE6OF02I0MLN.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgcttcgtttaagaggtgtccagtgtcaggtgcagctggtggagtcgtgggggacgcgtggcccagccctgggacctcccgtgacgtactctcctgtcgacagcgtctggacttcctaccttcagtagtcatggcatgcacgtcggtccggccaggcctccgaggacgaacgggcgtggaggtgggtaggcgtaagttacgtagtacggtatgagaggtttttaacgagtactaatactagtacgactacgtacgtccggtaggacgggaccgtacgtacctaccgtccgtacacgaacgaaccgtaacgtaacccgaacgaacgaccgtacgtacgtacgtacgtacgtaacctaaacgtacgaaccgtacgtacccgtaacggaacggtaaccgtaccggaacggaaccgtaacggtacgtaagttaacggttaagttaaccgtaggttaccggacggtacggtaacggacggtaacgaccgaccgtaaccgg

SEQ ID NO: 265840 - DNA, 600 bp, Homo sapiens
  misc_feature: GYAE6OF02HAJ67.34.26.C04.1.454.CMB.1.raw
  modified_base (307)..(307): a, c, t, g, unknown or other
  misc_feature (307)..(307): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtctgggggagcgtggcccagcctgggactccctgacgactctcctgtgcagcgttctggtattccaccttcagtagtcagtggcatgcacgtgggtccncgaggctccgaggcgaaggggctgggacgtggggacgctagttatagtggtatggatgggaagttagtacaagttactagtcgactagtaccgtccggtaggacgggaccgtacgttaccgtacccgtcgtaccgaagaacgaactaacgtaacccgaaagtaaccgacgtactagtactcgtcgaacaagtccgaaccgacgcgtaggacgtacgaccgacggacgaccggtacgttacgtacggttacttacgtggtacgacggagtacggacgtacgacgtccctaacgg

SEQ ID NO: 265841 - DNA, 596 bp, Homo sapiens
  misc_feature: GYAE6OF02F7PJB.34.26.C04.1.454.CMB.1.raw
  modified_base (187)..(187): a, c, t, g, unknown or other
  misc_feature (187)..(187): n is a, c, g, or t
  modified_base (233)..(233): a, c, t, g, unknown or other
  misc_feature (233)..(233): n is a, c, g, or t
  modified_base (263)..(263): a, c, t, g, unknown or other
  misc_feature (263)..(263): n is a, c, g, or t
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagtacacgtgatcacgaccggtgctcgatttagtctagcgactttgggtttgggggtcgtgggagaggagcccgagcactagaggtcggcggtgtttcctattcggtgatcagcactgaacacagaggactcaccatggagtttgggctgagccttgggttttcctcggttgcttcttttaaagnggttgtccagttgtcgtaggtgcagcgtggtggaggtcgtgggggnggcggtggcccagcctgggacgtccctagngctctctgngcngctctggnttcnctcgatgtcatgcntcgcgacgtcggtccnccgaggcctccggaggccgaaggggctgggacggtgggngacgtaggtactagtggtatggatcggaagtntagtanacgtanggactagcgtcgtgaacggngtagtccgactctcgagacacaactccgaaagtacgcctaagtcgtacgtcacgctaaagacgtaccgataccgtaggaccgtaacgggcgaccggacgacggtacgtaagttaccggttacttaacggtttggaccgtacggactaaagggacgtacctaacggcccgtaaccgg

SEQ ID NO: 265842 - DNA, 556 bp, Homo sapiens
  misc_feature: GYAE6OF02GCLW5.34.26.C04.1.454.CMB.1.raw
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (474)..(474): a, c, t, g, unknown or other
  misc_feature (474)..(474): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagcctgggaccgtccctgagactctcctgtncngcgtctggattcaccttcagtagtcatggcatgccagtgggtcccnccgacggctccgaggcaagggggtctgggaggtgggggtcgcaggttatagtggtatgagttcgggaaagttagtacaaagttactagtgacgtagacgtcgtagggacgggtcctaagttccaccgtcctaccgagacgactaactacccgaagacacgctagtacnctgacaatcgacacgtccgtagacgtcgacgagaccacggtctaatagttactacgtgtgacgaggagtagcacgctaaccg

SEQ ID NO: 265843 - DNA, 644 bp, Homo sapiens
  misc_feature: GYAE6OF02FQTE0.34.26.C04.1.454.CMB.1.raw
  modified_base (177)..(177): a, c, t, g, unknown or other
  misc_feature (177)..(177): n is a, c, g, or t
  modified_base (277)..(277): a, c, t, g, unknown or other
  misc_feature (277)..(277): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtctgggggaggcgtggccccagcctgggacctccctgagactctcctgtgcagcgtctggattcaccttnagtagtcatggcagtgcacgtgggtccgccgaggcctccgagggccaaagggggcctgggacggtggggtgacgtagtttactagtgggtatggagtagggaaagttagtactaaagttacttagtcgcaagtaccgtccggtaggaacgggtccgtacttaccgaccggttcctaccgaagaacgtaacctaaaccgtaccccgaaaagaaaccgacgacgttacgtaacttccgtagaactaaacgtcgaaccgcgtaccgtagaacggacgacccggaagggacccaacggtccgttaagttcgttaacgtttacgtcggttaggacggtaacgacggtaacgaccgtaccggaccctaaccgg

SEQ ID NO: 265844 - DNA, 630 bp, Homo sapiens
  misc_feature: GYAE6OF02HIGGG.34.26.C04.1.454.CMB.1.raw
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
tcagtacacgtgatcacgaccggtgctcgatttagtctagcgactttgggtttggggctgggagggggaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacctccctggacgactctccgtgtcgcagcgttctggattccgaccttnagtagtcatggcatgcacgtgggtccnccgaggcctccgagggcaaggggctgggaggtggggtgctagttatagtggtangagtggaagttagtacaattactagtcgacacgtacgtccggaggaacgggcccgtagttaccgaccgttcctaccgaacggacgaactaaaccttacccgaaagaacctacgacgttacgtaacttcgtaacgactaaacgtccgaaccgtacgtcccgaggtacgacggaccgacggaccgtacggtaccgttaagtacgttaactttaccgtggtacggtacggaacgacggaacgtaaccgacggacccttaaccgg

SEQ ID NO: 265845 - DNA, 759 bp, Homo sapiens
  misc_feature: GYAE6OF02HRNKE.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccaatggagtttgggctgagctgggttttcctcgttgctcttttaagaggtgtccagtgtcaggtgcagctggtggagtctgggggaggcgtggcccagccctggggaccgtccctgagactctcctgtcgcagcgtctggacttcaccttcagtagtcatggacatgctacgtgggtccgccgaggcctccgagggcaaacgggggctagggtacggtgggggtggacgtaaggtttacttagttgggtaattggaagttaggaaacggttagttaccgtaaaagttaccgttaagtcgacgtaacggtacccgttaccggtaggaaccggggtaccgtacgtttcccgtaacccggttacctacccgaaggtaacgaacccgtaaaccgttaacccccgaaaaggaaaccgtaaccggtaccgtaacggttaactaccgttaacggtaaccgtaaaacgtccggtaaacccgtacggtaccctacgggaacgaaccggtacccgggaacgggtaacccgtaacgggtaccgttaacggttaacgtttaacgttaaccgttacgggttaacgtaccgggtaacggtaacggtaaccggaacccggtaccggaaccccgttaaaccggg

SEQ ID NO: 265846 - DNA, 723 bp, Homo sapiens
  misc_feature: GYAE6OF02HBLNM.34.26.C04.1.454.CMB.1.raw
  modified_base (149)..(149): a, c, t, g, unknown or other
  misc_feature (149)..(149): n is a, c, g, or t
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (246)..(246): a, c, t, g, unknown or other
  misc_feature (246)..(246): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgancgtgggttttccngttgcttcttttaagnggtgtccagtgtcaggtgcagtctgggtgagtcgtgggggagcgtggcccagcctgggacctcctganactctcgtgcgcagtcgtacgtggacttcaccttccagttagtcagtcggacagtcgcgacgttcgggccgccgaggcctaccgaggccgaagggctaggtaggtggtggactaggttactagtaggtatcggaagtaggtaattcggtactaaagttaccgtanaccgtacgacggtaccgttcggtaacgggtaacgggtccgttaacgtccgtacccgttacgtaccgtaacggtaactaaccgaaccttaacccgtaaacgaacccgtacgtacgttaccgtaacgtttcgaaacctaaacgtaacgtaccgaaacccgtacgaacccgtaacgggaaaccggaccggtaccgggtaacgggtacccgaccgggtttaacgttaacgttaaaccggtttaacgttaccgttaggtaaccgggtacggaacgggtaacggtaccggtaacgtacccggtaacccgttaaccggg

SEQ ID NO: 265847 - DNA, 624 bp, Homo sapiens
  misc_feature: GYAE6OF02G402D.34.26.C04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctcttttaagnggtntccagtgtcaggtgcagctggtggagtcgtgggggagcgtggcccagcccgtgggacgtccctggagaccttctccgtgtgcagccgtctggattcaccttnagtagtcatggcatgcacgtgggtccgccgaggtcctccgagggcggaaaggggtcgtagggacggtgggggtgacgtagtttaagtagtggttagtcgaagttagggaaaggttagtacaaagttactaagtcgagtacgacctcggtaggtaacgggtccgtactccgtacccgttcgtaccgagaacgaacaaccgtacccgtaaagaacctaccgccttagtacttacgagaactaagtacgacaccgactaggacgaacggaccggtacggacgtaccggtacgtaagtacgttattacgcgttagaccggtagacgtagaccgtacgaccgtacg

SEQ ID NO: 265848 - DNA, 760 bp, Homo sapiens
  misc_feature: GYAE6OF02HFI73.34.26.C04.1.454.CMB.1.raw
  modified_base (260)..(260): a, c, t, g, unknown or other
  misc_feature (260)..(260): n is a, c, g, or t
  modified_base (268)..(268): a, c, t, g, unknown or other
  misc_feature (268)..(268): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctccctgacgactctcctgtncgagcgtntggattccacctttcagtagtcaagtggctagtcgcgacgtcggggtcccgccgaggccttaccgagggccggtaaagggggccttgggagggttggggtcggacgtaaggttagtaaggttgggtaatcgggtaagttagggtaaagttacgaacgttaaagttaccgtaacgttgaactacggtaccgttaccgggtacgggtaacggggtacccggtaactttccccgtaaccgttaccgttaccggaagaaacggaaccgtaaacccgttaacccgaaaacgaaaccctaaccgggctttaccggaacttcgtaaccggtaaactaaacgttacgaaccctaacggtcccgtaaaggtaacggaaccggaccgggaaaccggtaccggtaacccgggtaccttaaggttaaccggttttaaacttaccggttaacgtccgggtaacgagggtaaaccggaacggtaaccgaccggtacccgtaaccgg

SEQ ID NO: 265849 - DNA, 772 bp, Homo sapiens
  misc_feature: GYAE6OF02JJWH0.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcgaggtgcagctgggtgagtcgtgggggagcgtggcccaggcctgggaccgtccgtggacgactccgtccgtgtgacgacggtcgtcgtaggacttccaccttgaggtacgtcaacgttggaccagttcgccgtaacggttcggggtaccccgcccgtaggccttcccggaagggtaccgaaacggggtctagggaggtcggggtagctaaaggttacgtagttacgggtatacggaacgtttagggaaatttacggtacctaaagtttaccgaaggttcggaaaccgtacggtaaaccggttcccgggttaaagggaaccgggttaccggttaacgttacccgtaaccggttcctaccgtaaaggaaccgtaacctaaccgttaacccgaacggtaaaccgtaccgtacgttaccggttaactacgtacgttaaaccgaaagttcccgtaacgaccgtaaccgttaggacgaacccggtacgggaaccgacgtacggaccttaaacggttacgttaacggttaccacgggtagtaacccgggtaagacccggtaaggtaacccggtacgtaccccgtaacgg

SEQ ID NO: 265850 - DNA, 815 bp, Homo sapiens
  misc_feature: GYAE6OF02H2590.34.26.C04.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggaactgagcttgggttttccctcgttgcttcgttttaagaggtntccagtgtcaggtncagctggtggagtcgtgggggagtcgtcggccaggtccgtggggacctccctggacgtaccttctccgtggtcgcagcgttctggtatttccacctttgaagtcgtacagtggctagtcgacctacgttcggggcccacgacggtcctaccgagggacgtaaggggtcgtagggtaggtcggggtaggctaagtttagaggttaggtataggtacggtttagggaaagttacgtaactaaagttacgtgtacgaccgtaacggtccgttacgggtaacggaacgggtaccgttaaccgttacccgtacccggttcctaaccgggaaacgtaaccggtaaaaccttaaacccgttaaaccccgaaaaaccggtaaccgtaacccggttacgttaacggtaacccgttaccgttaaacgggaaaccttaaaacgggttcccgaaacccggttaacggtaacccgttaacgggaaccggtaaaccgggacccggtaaaccggaccggttaacgggtaccttaagggttaacccgttttaacgttaaccggttacggaaccgggttacgaaacggggtaacggtaaacccgaaccgtacccggtaccccgtaaacggg

SEQ ID NO: 265851 - DNA, 643 bp, Homo sapiens
  misc_feature: GYAE6OF02HA8GP.34.26.C04.1.454.CMB.1.raw
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagtcgtgggggagcgtggcccagcccgtgggaccgttccctggagacctctcctgtgcagcgtctggattccaccttnagtagtcatggcatgcacgtcggggtcccnccgagggcctcccgaggccgaaggggctgggaggtggggtggctaggttatagttggtatcggagtgggaagtagtacaaattacgtatgcaagtacgtccgtaggaacgggcgtacttccgacccggttcacccaggaacgaaccgaaacctacccgaaagaacccacggtactagtaactctacggtaacaaaacgtcgaacccacgtacctacggaacggaaccgtaccgaaccgggtaccgtacgggtaccgttaagtttacgtaacgtttaacgtaggttacggaccggagggtaacgaccgggaactacggaccctaaccgg

SEQ ID NO: 265852 - DNA, 672 bp, Homo sapiens
  misc_feature: GYAE6OF02HJI0L.34.26.C04.1.454.CMB.1.raw
  modified_base (186)..(186): a, c, t, g, unknown or other
  misc_feature (186)..(186): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggtttttcctcgttgcttcgttttaagaggtntccagtgtcaggtgcagctggtggacgtcgtgggggagcgtggcccagccgtgggacctcccgtagacgaccttcctcctgtgcagcgtcgtggattcgaccttgagtagtcagtggcagttgaccgtacgtcgggtccccgacacgggtcctccggagggccgaaggggtcctggggaaggtggggtggacgtaggtttacgtagtagggttatggaagttagggaagttacgtacgtaaaattacgtaagtccgacgtaacggtaaccgttccgggtaacggaacgggtcccgttaaacgttccgaaccccgttcgtaccgaaggtaacgaaccgaaccttacccgaaagaacccagtaccttagtacttacgacgtaacgtaaacgtcggaaccaggtaccctaggaacgcggaccgagacgacggtactaagttcgtaacttcgtacgtagacggtacggacgacgacctacggacctacgg

SEQ ID NO: 265853 - DNA, 562 bp, Homo sapiens
  misc_feature: GYAE6OF02GEEMT.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgctcttttaagaggtgtccagtgtcaggtgcagctggtggagtcgtgggggagcgtggcccagcctgggacgtccctgagactctcctgtgcagcgtctggattccaccttcagtacgtcagtggcagtcgcacgtcggggtcccgccgaggcctccgaggcggaaggggctgggaggtggggtgcgtagttatagtggtatgagtaggaagtagtacaatactatgacagtctcgtaggacgggcgtagttcaccgtcacagacgacaacgtacccaagacacgctgtactctagactaagtacgacagccgtagacgacgccgaaggaccgacgtactacgttattacgttacgtagtacggaggtacggaagaggaaccgtacgcctaaccgg

SEQ ID NO: 265854 - DNA, 758 bp, Homo sapiens
  misc_feature: GYAE6OF02GAKN2.34.26.C04.1.454.CMB.1.raw
  modified_base (407)..(407): a, c, t, g, unknown or other
  misc_feature (407)..(407): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcgaggtgcagctgggtggagttcgtagggggagcgtcggcccagccgtgggacctccctaggacgtactcctccgtggtgccagcgtcgtggactttcgaccctttgagtacgtcagttcggctatcgcctacgtcgggtcccgaccgaggtcctaccggaggcccgaaaggggggcccttagggggaacgggttggggtacggacgttaaggtttanaaggttcgggtagtcgaaggttacgggtaaagttcggaactaaaagttcgttaagtcgaccgtacggtaccgttccgggtaggtaacggggtaccctaaagtttcccggaaaccggttcctaccggtaacggaacgtaaacctaaccgttaacccgaaacgaaccctacggtaactcgttaaccgtcgtaacggaacctaagtaccgaaccgacgtaccgtaggaacggtaccgaccgggtaaccgaccggtaaggtaccctttaaggtacgttttaaccgttacccggtacggttcggtaaccgggttacgaagggtaacccgacgggttacccgaccggttaacccggg

SEQ ID NO: 265855 - DNA, 671 bp, Homo sapiens
  misc_feature: GYAE6OF02FIFSD.34.26.C04.1.454.CMB.1.raw
  modified_base (161)..(161): a, c, t, g, unknown or other
  misc_feature (161)..(161): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
  modified_base (297)..(297): a, c, t, g, unknown or other
  misc_feature (297)..(297): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccngttgctntttaagngtgtccagtgtcaggtncagctggtggagtcgtgggggacgcgtcggcccaggccgtagggacctccctaggacgtacctccgtccgtggtcgccaggccgtcgtaggacttccaccgtttnagttacgtcagttcgggacctagtcgctacggtggtcccgaccgaggcctaccggaggcgaagggggtctaggggagttcgggggtgactaggtttatacgtgggtactgtaagtggaaaagtgtactaaagttctagtcggactaacggtaccgtaccggtaggaacgggtcctaacgtttccgacccggttaccgtacccggaagaacggtaacctaaccgtaacccggaaacgaaccgtacgtccgtaggttactacgtacgaactaagtccgaaccgtacggtaccaggaacgacggacgaacggtaccgacggtctaacgtacggttaactcggtagcgtacggagtaacgacgacgtacgacctacgg

SEQ ID NO: 265856 - DNA, 701 bp, Homo sapiens
  misc_feature: GYAE6OF02I00RY.34.26.C04.1.454.CMB.1.raw
  modified_base (184)..(184): a, c, t, g, unknown or other
  misc_feature (184)..(184): n is a, c, g, or t
  modified_base (588)..(588): a, c, t, g, unknown or other
  misc_feature (588)..(588): n is a, c, g, or t
  modified_base (647)..(647): a, c, t, g, unknown or other
  misc_feature (647)..(647): n is a, c, g, or t
  modified_base (680)..(680): a, c, t, g, unknown or other
  misc_feature (680)..(680): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggttttcctcgttgcttacgttttaagnggtgtccagttgtcgaggtgcaggcgtggtggagttcggtgggggaggcgtcggcccaggccgtgggaccgtccgagacgaccttccgtccgtggtcgccaggtccgttcgttaggactttccctacctttcgaaggttagtaccaggttcggactagttcggacccgtaccggttcggggtcccgaccgagggtccctaccgaaggggtccggaaagggggccgtttaggggaccgggttgggggtccgagttaaagtttaggtaggttaggtagtaaggagggtttagggaaagttacgtacgaaattacgttaggctaacgaacgtacgtacgggagggaaaccggtcgtaatcccgtacccgtagtaccgaggaaactactacgaaccaaacgctaccgntcgtaagttcaacgactaaacgtcaacgtcgacgtgaacgagtaccgacgtacgaacgnttaagtattaccgtagagtacgcggtaaacggntaaccggaactccaaggtacc

SEQ ID NO: 265857 - DNA, 772 bp, Homo sapiens
  misc_feature: GYAE6OF02JMXGW.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtcggcccgagtcccgtggggaccgtccctaggacgaccttccgtccttaggtgccaggcgttcgtggtacttccaccgtttcagttagtctaagtcggactagtcgactacgtcgggtcccgcccgagggccctaccgagggccgtaaagggggccgtggggtaggtcgggggtcggactacggtttaagtagtcgggttaatggtaagtacggggtaaaaggttacgtacctaaaagttaccgttaagcgaaccgtaaggttaacccgtttacccggtaaggggtaaaccggggtacccgttaacggtttaccccgaacccgggttccttaacccggaaacggtaacgtaaacccgtaaaccgtaacccccgtaaaagaaacccgtaccggtaccgtttaagtaacttcgtacgaaaccgtaaaggtaccaaccggtaacgtaccgtcggaaacgggcaaccggggagaccgtaccggacgttaacgtagtttaacctccggtagtacggacggaacgtacggaacggtaccgaccggtacccgtaacgg

SEQ ID NO: 265858 - DNA, 590 bp, Homo sapiens
  misc_feature: GYAE6OF02JZDNR.34.26.C04.1.454.CMB.1.raw
  modified_base (356)..(356): a, c, t, g, unknown or other
  misc_feature (356)..(356): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
  modified_base (471)..(471): a, c, t, g, unknown or other
  misc_feature (471)..(471): n is a, c, g, or t
  modified_base (560)..(560): a, c, t, g, unknown or other
  misc_feature (560)..(560): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtgtcctagtgtcaggtgctagctggtaggagtcgtgggggagcggtggaccccagccgtcgggacctccctggaagcctctccgtagtgcagtctactggattcaccgttcagtagcagtgcatgcacgtcggtccgacagggcctacgaggctaaggggctagggacgtggggtnccgtaagttanacgttggtatgatcgggaatagctaaattcngtcgactagtctccggtagacgggtacacgtcaccgtnacctggaacaacgaactcccaaagaccacgtctanagttcataagaaactcgtaacacgtctaacggacgacggtaccgaagaccgacgtaccggtaattacgttaacgtacgttgtaaccggngtaacgaagtaccgtagtacgacctaacgg

SEQ ID NO: 265859 - DNA, 654 bp, Homo sapiens
  misc_feature: GYAE6OF02HIWF3.34.26.C04.1.454.CMB.1.raw
  modified_base (280)..(280): a, c, t, g, unknown or other
  misc_feature (280)..(280): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggagcgtggcccagccgtgggacctcctgacgactctcctgtgcagctcgtggatttccaccttnagttagtcagtcggcagtcgacctacgtcggggtcccacgaggtcctccgaagggccgaaagggggtctgggtacgggtgggtcggactaaggtttatagtggttaatggtacgtagggaaagttacgtactaaattactagtcgactaacggtacgttccggtaggtaacgggaccttacgttaccgaacccgttcgtaccgaaggaaccgaactaaacctacccgaaacgaacctacgtactagtaactcgtaagaactaagacgaaccacgtacctaaggacgtaacggccgtaacgggacctacggtaccgttagttacgttattacgtaggtacgtacggacgtaacgacgaaccgacgacctaacggg

SEQ ID NO: 265860 - DNA, 635 bp, Homo sapiens
  misc_feature: GYAE6OF02I4F7I.34.26.C04.1.454.CMB.1.raw
  modified_base (180)..(180): a, c, t, g, unknown or other
  misc_feature (180)..(180): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (293)..(293): a, c, t, g, unknown or other
  misc_feature (293)..(293): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttcctcgttgcttacgttttaagnggtgtccagtgtcgaggtgcaggctggtggagtcgtgggggagcgtgccagccgtgggacctcctgacgctctcngtgcagctntgatcaccttcagtgcagtggcatcgacncgtcgggtccacgagcctccgaaggcgaaggggctagggcggtgggacggactaaggttagtagtgggtatggtaagtacggtaaaaggtctaacaaagttacagtcgaccgtaaggtaacccgtcggtaacggaacggtccgtaattcccgaaccgtctaccgaaggaactacgtaaaccacccgtaaaggaaacctcgggtaaccttaggtaacccttcggtaacctaacggtaaacctcggaacccgtaagcccgtagggaccgtaacgaccgagaccgtacgtattagtaacttacgtagtccggtagacggagtacgacgacgttacgaccctaggg

SEQ ID NO: 265861 - DNA, 608 bp, Homo sapiens
  misc_feature: GYAE6OF02HN9WQ.34.26.C04.1.454.CMB.1.raw
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacctccngagctctcctgtgcagcgtcgtggattccaccttcgagttatcagtcggcatcgccacggtgggtcccncgaggcctccgagggcgaaggggctagggagtggggngctaggttangtggtatggtacgtaggaagtntacaattcgtagtgactagtacctcggaggacgggtccgtagtccgaccgtctaccgaagacgaacaactacccgaaagaccacgtctagtactcgagaactaacgacgaccgacgtaccgaggacgcgtacgaacgggaccgtaacgggtccgttaaagttaccggttaacttacggttacggtacggacggaaggtaccggaaggtaacccgacggaccctaacgg

SEQ ID NO: 265862 - DNA, 699 bp, Homo sapiens
  misc_feature: GYAE6OF02IGSCT.34.26.C04.1.454.CMB.1.raw
  modified_base (162)..(162): a, c, t, g, unknown or other
  misc_feature (162)..(162): n is a, c, g, or t
  modified_base (271)..(271): a, c, t, g, unknown or other
  misc_feature (271)..(271): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccatggagtttgggctgagctgggttttccncgttgctcttttaaagaggtgtccagtgtcaggtgcagctggtggagtcgtgggggagcgtggcccagtccgtgggactcccgtgagactctccgtgtgcagcgttcgnggacttcacctttgacgttagtctatggcatgctacgttgggtccgccaggtcctccgaagggtccaaagggggtctagggacggtaggggtcggcgtaagtttacgttaagttagggttaagacggtagttacggggaaaaagtttaccggataaaacgttaacccttttataccggactaaacggtaccgttaccgggttaacgggtaaaccggggaccgttaaccgttaccgtaccgttaccgtacccgaaggacgtaactaaaccgttaaccccgaaacggtaaccaaccggtcttaacgtacgtacgttacgaaactaaacgttaccgacctacgtacctaggaacgtaacggtaccggagtaccgacggtatacggttagtacttacgtacgtggacgaacgtaggaacacgcgacctacgg

SEQ ID NO: 265863 - DNA, 915 bp, Homo sapiens
  misc_feature: GYAE6OF02IDIFI.34.26.C04.1.454.CMB.1.raw
  modified_base (176)..(176): a, c, t, g, unknown or other
  misc_feature (176)..(176): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttggctgagctgggttttcctcgttgcttcttttaagnggttgtcctagtgtcgaggtgcagcgtggtggagtcgtgggggagcgtgccagccgtggactcctgacgactctccgtgtcgcacgccttcgtggactttccgtaccttcgagttacggtacctagttggattcgaccgtacgttcggggttacccgtaccgtaaaggttcccggaaggggggtaacggggccgttttagggggttggttttacgggggttttaccctaacgggttttaacgttaaccgggtaagggttttcggtaaaacgggttcgggggtaaccttaccggggaaacctaaaccgtaaaacgtttccggtaaacccgggggtaccccgggttaaacccgttaaccccgggggttaaggggaaaaccggggtcccccgtttaaccgtttacccccccgtaaccccccgtacccgtaacggaacccgtaaaccccggaaaacccgaaccgtaaaaccgtaaacccgtaaaccgtaaccgttaaacttaaccgttaacccgtaacgtaaaccgtaaaacgtaccgaacgtaaccgttacgttaacggacggtaaccgaccggtaaccggaaccgtaccgggtaccgttacggttacgttaacgttaccgttacggttaaccgtaaccggtaaacgggttagggtaccggtaaccgttaaccgtaagttacccggttaaggtttacgggtttttacgttaaccgtttccggttaccggggttaacccgggg

SEQ ID NO: 265864 - DNA, 654 bp, Homo sapiens
  misc_feature: GYAE6OF02GDOHI.34.26.C04.1.454.CMB.1.raw
  modified_base (177)..(177): a, c, t, g, unknown or other
  misc_feature (177)..(177): n is a, c, g, or t
  modified_base (373)..(373): a, c, t, g, unknown or other
  misc_feature (373)..(373): n is a, c, g, or t
  modified_base (445)..(445): a, c, t, g, unknown or other
  misc_feature (445)..(445): n is a, c, g, or t
  modified_base (493)..(493): a, c, t, g, unknown or other
  misc_feature (493)..(493): n is a, c, g, or t
  modified_base (516)..(516): a, c, t, g, unknown or other
  misc_feature (516)..(516): n is a, c, g, or t
  modified_base (598)..(598): a, c, t, g, unknown or other
  misc_feature (598)..(598): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggtttcctcgttgcttctttaagnggtgtccagtgtcgaggtgcagcgtggtggagtcgtgggtgacggcgtcggccctagcccgtgggaccgtcccgtggtacgactcctccgtagtcgcgaagccgtcgtaaggtcttctaaccttcgagttagcgtagtcggactgttgccgtacgtcgggtccccgctaaggccttaccggaggcgaacggggtcnggggtaaggtggtacggctagttacgtgttagaccgtagagtagggtaaaccgtgtaaccaagtaccgttancggactacgtcggtacttagggacgggtcctagttcgtacccttcganaccgtgaacgttaaccaccgaanaacccgctacgtcgacttacgacgtaacgaaactcgaaccctaggccttaggacgaccggttaacacggggaccttaccggntaaacggtgttaacctaggtttcgaggaaccgtagggtactaacagggtacctccg

SEQ ID NO: 265865 - DNA, 643 bp, Homo sapiens
  misc_feature: GYAE6OF02GEMEP.34.26.C04.1.454.CMB.1.raw
tcagtacacgtgatcacgaccggtgctcgatttagtctagcgactttgggtttggggctgtgagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtatcagtggcagtgccacgtgggtcccgccgaggcctaccgaggcgaaaggggctagggaggtggggtgcgtagttaatgtgggtatggtaagtggtaaagtgtacaaagttactagtcgcaacgtaccgtccggtagggacggggtccctattcccgtaccggtccttacccaaggaacgtacctaaaccgtacccgaaacggaaccaaccgtcttacggtaacttccgtacgaacctaaagttccggaacctacggtccctaaggacgtacgggacccggagggtaaccgtaccgggaacgttaagtacggttacttaaccgttggtacggtacggaaggtacgaacgggtacgacgtacccg

SEQ ID NO: 265866 - DNA, 670 bp, Homo sapiens
  misc_feature: GYAE6OF02HDJ78.34.26.C04.1.454.CMB.1.raw
  modified_base (161)..(161): a, c, t, g, unknown or other
  misc_feature (161)..(161): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (280)..(280): a, c, t, g, unknown or other
  misc_feature (280)..(280): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttccncgttgctctttaagaggtgtccagtgtcaggtgcagctggtggagtcgtgggggagcgtggcccagccgtgggacgtcccngagacctctcctgngcagcgtcgtaggattccaccttnagtagtcagtggacatgaccgtacggtcgggtcccaccgtaggcctaccggagggaccgtaagggggctaggggacggttgggggtcgcgtaaggtttatagtaggtaatggtaagtacgggaaattagtactaaaagttctagtgacgtaaggtcccgtcgtaggaacggccgttactcccgtaccgtactacccgaggtaacaacgtaaaccgtacccgaaaagtaacccgaccgtctacggttactaccgtacgaactaacgtacgaaccgtacggtaccgtaggaaccggacgacggacgaccgttacggacgttacgttacgttaacgttacgtacggtacgaccgggtaaggaacgtaacggtaaccccgtagaccccgtaagg

SEQ ID NO: 265867 - DNA, 611 bp, Homo sapiens
  misc_feature: GYAE6OF02JFZRF.34.26.C04.1.454.CMB.1.raw
  modified_base (176)..(176): a, c, t, g, unknown or other
  misc_feature (176)..(176): n is a, c, g, or t
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagnggtgtccagtgtcaggtgcagctggtggagtcgtgggggagcgtggccagcctgggactccctgagctctcctgtgcagcgtctggacttcaccttcagtacgtcatggcatggaccacgtgggtacccnccgaggtcctccgaggcaagtcgggctgggagtgggtgctagttatagtggtactggacgtaggaagttagtcgaaattacgtagtcgaacgtacggtaccgtaccgggtaggaaacgggtcccgtagttacccgaacccggttccttaaccggaaggaccgttaaaccgaaacgtaccccgaaacgaacctaccgggtactaggttaactcgtacgaactaagtccgaacgacgcgtagacggtacgaccgaggacgtacggctatagtacttatggcgacggtagaggtacgaccgagtaccg

SEQ ID NO: 265868 - DNA, 682 bp, Homo sapiens
  misc_feature: GYAE6OF02J1LC3.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtgagtcgtgggggagcgtggccccaggccgtgggaccgtccctggagactccgtcctgtgccgagtccgtctggacttccgaccttcaggtacgtcagtcgggcatcgccacgtcgggtcccgaccgtaggcctccggagggaccgaacggggtctacgggaggttggggcgtacgtaggttaatggtggttatggagtggtaaacgtagtaactaagttacctagtagacctaggtacctcggtaacggaaccggtcgtacgttacccgaccgtcctaccgaacgaacgtaactaacctaacccgtaaacgaactaccgtacgtacgtacgtcgttacgaactaacgtaccgaccgtacgaccgttacggaacggacggtacccgggaacggaccgtaaccggacgtttaacgttcggttactaccgttaggtaccgtaggacggtaacggtaaggacccgtacggtacccgtaaccgg

SEQ ID NO: 265869 - DNA, 696 bp, Homo sapiens
  misc_feature: GYAE6OF02FZIA0.34.26.C04.1.454.CMB.1.raw
  modified_base (161)..(161): a, c, t, g, unknown or other
  misc_feature (161)..(161): n is a, c, g, or t
  modified_base (177)..(177): a, c, t, g, unknown or other
  misc_feature (177)..(177): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
  modified_base (596)..(596): a, c, t, g, unknown or other
  misc_feature (596)..(596): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtggttttccncgttgctcgtttaagnggtgtccagtgtcaggtgcagcgtggtggagtcgtgggggagcgtggcccaggccgtgggacgtccctgagtacctctcctggngcgagcgtntggattcgaccttgagtagtccagtggcagtcgcacggtgggtcccgcgaaggtcctccgaagggtcgaaacggggtctacgggagtcgggttggctaggtttacgtgtgggtactggaacgtgggtaaaaggttcgaaccgtaattaacgttacgtaggtaaccagtaccggttccggaagggaacggggttccgtaagttaccgtaccggttcctaccgtaagaccggaacctaaccgtaccgaaacgtaacgcctacgtagtactcgtaagaccgtaaacgttccgaccggtaacgtccgtaagggaacgaccggtaaccggnggtaacccgtagggtcctaaacgggttaccggttaacgtttaacgtccggttaggaccggtaagggtacgaacggtaaccggaccgtaaccggtacccgg

SEQ ID NO: 265870 - DNA, 565 bp, Homo sapiens
  misc_feature: GYAE6OF02HBCXA.34.26.C04.1.454.CMB.1.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctcttttaagaggtgtccagtgtcaggtgcagctggtggagtctgggggagcgtggcccagcctgggactccctgagactctcctgtgcagcgtctggattccaccttcagtagtcatggcatgcacgtggtccncgaggctaccgaggcaaggggctagggaggtggggngcagttatatggtatgagtggaagtacgtactaaagtacttaatgctaaggacctaccggtaggaaacgggccagtttccaaccgtcctccgaagacgaacaactaacccaagaaccacgtctagtactcagacaaatacgacctagacctgacgaacgccgaagggacacgggtctaagtacgtaacgttactggttagacggaagagtaaggactaggacctaccgg

SEQ ID NO: 265871 - DNA, 709 bp, Homo sapiens
  misc_feature: GYAE6OF02JIJP1.34.26.C04.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (193)..(193): a, c, t, g, unknown or other
  misc_feature (193)..(193): n is a, c, g, or t
  modified_base (216)..(216): a, c, t, g, unknown or other
  misc_feature (216)..(216): n is a, c, g, or t
  modified_base (295)..(295): a, c, t, g, unknown or other
  misc_feature (295)..(295): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccngttgctctttaagngtgtaccagtgtcaggtnacagctggtgagtcgtgggggancgtggacccagccgtagggactcccgtagacgtactcctcgtcgtgccaggctcgtggtaactttcctaacttgaagtnctaggtcgactgtaccncgtacggtcggtaccgaccgaggtcctacggagggtacggaaggggtcgtaggggtacggtggggtaccgtactaagtttagacggttggtaacgtggtaggtaacggtaattgaacttaatacgtagtcgaacgtaccgtccgttacggtaagggaaccgtacgttaccgtaccgtacctcggaaccgtaagaaccggtacctaaaccgtaaccgaaacgtacgtacggtacgttagtaccgtttacgaacggaaaccttaacggtccgtaaaccgtacggtaccgtaaagggacccggtaaggacccgggttaagaccgtaacgtcgtttaacgttagttaacgtaccgtagggtccaaggtaccgaaagtaccggacgtacggtacccgtaagg

SEQ ID NO: 265872 - DNA, 670 bp, Homo sapiens
  misc_feature: GYAE6OF02H5QDK.34.26.C04.1.454.CMB.1.raw
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (658)..(658): a, c, t, g, unknown or other
  misc_feature (658)..(658): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtgagtcgtgggggagcgtggcccagccgtgggacgtccctgacgacctctcctggtcgcaggccgttcgtggtacttcaccgtttcaggttagtccagttcggactagtgcctacgttcgggtcccgccgagggcctccgaagggacggaaggggtctggggtaggtgggngtacgtagttntacggtgtagtggacgtaggaagttacacgtaaatctaagtcggactaacggtccgtacggtacgggaccggtccgtaacttcccgtaaccgtcgtacgaagtaaccgtaactaaccgtaacccgaaaagtaaccgtaccgtacttacggtaaccttcgtacgtaaacgtaatacccgtaacgaccgtaccgtaggaaccggtaccggtaccggaacgaccggtacgttacgagtttactagttaacgtgtacgacgtacggacgacgtaacnccggactaccgg

SEQ ID NO: 265873 - DNA, 586 bp, Homo sapiens
  misc_feature: GYAE6OF02FN8PY.34.26.C04.1.454.CMB.1.raw
  modified_base (368)..(368): a, c, t, g, unknown or other
  misc_feature (368)..(368): n is a, c, g, or t
  modified_base (398)..(398): a, c, t, g, unknown or other
  misc_feature (398)..(398): n is a, c, g, or t
  modified_base (488)..(488): a, c, t, g, unknown or other
  misc_feature (488)..(488): n is a, c, g, or t
  modified_base (576)..(576): a, c, t, g, unknown or other
  misc_feature (576)..(576): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctggggttttcctcgttgctcttttaagaggtgtccagtgtcaggtgcagctggtggagtcgtggggggaggcgtggcccagcctggggaccgtccctgagactctcctgtgcagcgtctggattcaccttcagtagtcatggcatcgcacgtcggggtcccgcaggcctcgacggacggaggggctgggaggtggggtgactaggttatggtaggtangtagtaggtaagtatactaatcgtagcganacgtcgtcgaggacggtctatcgtaccgtctacagacacctaacgtaccaaagacacgtcgtacgtactcgacaacgtaacgaccgaacnccggtcgtaagacgaccggtacggaacgacgtcgaacgttactagttaacttaaggcggtaagtacggaaggtaggaacaccggtacncccgtaacgg

SEQ ID NO: 265874 - DNA, 647 bp, Homo sapiens
  misc_feature: GYAE6OF02HOSKS.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggcccaggcctgggacctccctgagacctctcctgtgcagcgtctggtattccacctttcagttagtcagtggcatgccacgttcggggtcccgccgaggcctccgagggcgaagggggctgggaggttcgggggtggctaaggtttataggttgggtacgtggtaagttagggaaagttacgtacaaagttacgtatcggacaggtaccgtccggtaggaacgggtacctagttcccgaccggttacctaccgaggaacgaacaactacccgaacgaaccgtaccgtctagtactacgtgtaacctaaagtccgaaccgacgtcccgtaggaacgaccggtaccgaacggaccgacggttacgtaacgttagttaacttacgttcggaacggacgaggtaacgacgacgtaccgaccctaacgg

SEQ ID NO: 265875 - DNA, 756 bp, Homo sapiens
  misc_feature: GYAE6OF02HYDAA.34.26.C04.1.454.CMB.1.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaagaggtgtccagtgtcaggtgcagctgggtggagtcggtgggggaggcggtcgggcccagcccgtgggaccgttccctggacgtacctctccgtgtcgcagcgtctggacttcaccttcgagttagtcagtggccagtcgcacgtcgggtccgccagggtcctccgagggaccgaaggggtcgtagggaggtggggnggactaggtttanacgttggttanggtacgtagggtaaagttacggacctaaagttacttaggtacggtacgaaccggttaccgttaccggtaaggtaacggggccccgtttaaacgttacccggtacccggttaccgttaacccgaacgggaaccgtaaacctaaaccgttaacccccgaaagtaaacccgaccgttaaccgtaacgtttacgttaaccgtaacgtaaccgaaaacgtaccggaaccgacgaccgtttaggaaaccggtacgggaaccgaacgggaccggtaccgtaacggtaacgtttacggtttaaaccttacggttacggtacggtacggtaacggaacgtaaacgggaaccgtaccggccgtaaacccgg

SEQ ID NO: 265876 - DNA, 665 bp, Homo sapiens
  misc_feature: GYAE6OF02IDRDG.34.26.C04.1.454.CMB.1.raw
  modified_base (193)..(193): a, c, t, g, unknown or other
  misc_feature (193)..(193): n is a, c, g, or t
  modified_base (359)..(359): a, c, t, g, unknown or other
  misc_feature (359)..(359): n is a, c, g, or t
  modified_base (420)..(420): a, c, t, g, unknown or other
  misc_feature (420)..(420): n is a, c, g, or t
  modified_base (474)..(474): a, c, t, g, unknown or other
  misc_feature (474)..(474): n is a, c, g, or t
  modified_base (505)..(505): a, c, t, g, unknown or other
  misc_feature (505)..(505): n is a, c, g, or t
  modified_base (540)..(540): a, c, t, g, unknown or other
  misc_feature (540)..(540): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttctcgttgcttactttaagagtgtccagtgtcaggtncagtctgggtaggagtcgtgggggggagtcgtcggacccaggtcccgtaggggaccttccctggaacgtccttctccgtgtacgccaggtccgtcgtagggtacttccgaacctttcgaaggttacgtccaagtcgggacaatcggacctacgttccggggccccncgaacggtcctacccgagggacaagggggctagggtaggtcggggtggactagggttaaanggttacggtatggaagtacgggtaaagtacggtacaaaagtttaccagttcganaacggtctccggtagaacgggcctagtaccncgtactaccgagacgaacaactaccaagaacacgntagaactctagacaagtcaaccagacctagacgaacgtaccggaagaccgtaaccgggtactaagttaccggttaattaccggttagagaccggtaagacggtaaacgacaccggtacctaaccg

SEQ ID NO: 265877 - DNA, 632 bp, Homo sapiens
  misc_feature: GYAE6OF02IF2XU.34.26.C04.1.454.CMB.1.raw
  modified_base (277)..(277): a, c, t, g, unknown or other
  misc_feature (277)..(277): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctcgttgcttcttttaagaggtgtccagtgtcaggtgcagcgtggtggagtcgtgggggagcgtggcccagcctgggctcctgacgactctctgtgcagcgtctggacttccaccttnagtacgtcagtggctatgcacgtcgggtccgcctaggcctccgaggcgaaggggctgggaggtgggtcgctagttagtagtaggtataggtatacgggtaaattagtacaaaacttacgtagtacgacgtacgtaccgttccggtagggaacgggtccgtacgtaccgtaccgtaccgtaccgaggtaaacgtacctaaacgtaacccgaaagaaccgaacgtcgtagtacgttacgtagaaaccacgtacgaaccgtacgtaccgtaggacgacggacgacggacgacggtacgtaacgtcgttaacgttaccgttgtacgaggacgaacggaacgaacgtaccgtacctacgg

SEQ ID NO: 265878 - DNA, 862 bp, Homo sapiens
  misc_feature: GYAE6OF02IOVLV.34.26.C04.1.454.CMB.1.raw
  modified_base (256)..(256): a, c, t, g, unknown or other
  misc_feature (256)..(256): n is a, c, g, or t
  modified_base (328)..(328): a, c, t, g, unknown or other
  misc_feature (328)..(328): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagctgggttttcctcgttgcttcttttaagaggtgtccagtgtcaggtgcagctgggtggagtcgtgggggagcgtggccagcctgggacctccctgagctctcctgtcncgagcgtctggtacttccaccttcaagttcgtcagtcggacagtgacctacggttccggggtcccgacccgngggtaccctaccggaacgggaccggaaacgggggtcgttacgggggtaagggttcgggggtacggtacctaaaggttttaacgttagttcgggtttaagtcgggtaaacgtttggggtaaaacgttacggtaacttaaaagttccttaaggcggtacccaaaggttaccccgtaccggtacgggtaaacgggtacccgtaactttcccgaccccggtttccgtaccgaaagggaacccgtaaccgtaaacccttaaccccggaaaacggtaacccaccgtttcgttaaccgttaaccttcgggtaaccctaaacggtaaaccgttaacccgggaaacccgtcggttaaaccccgtacggggtaaaccgggaaaccccggtaccggggaaacccgggtaccggtaacccgggtttaacgttaaccggttttaaaccgggtttaaaccgttttcgggttaccggggtaaccgggtaacggtaaaccgggaacggttaaccggaaccccggtaccccggaaccgtttaaacccgggg

SEQ ID NO: 265879 - DNA, 774 bp, Homo sapiens
  misc_feature: GYAE6OF02GC69T.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtggggggaggcgtggcccagcctgggacgtccctgagactctcctgtgcagcgtctggattccaccttcagtacgtcagtggctagtcgacacggtcgggtccgccgagggcctaccgagggcgaagggggtcgtagggtaggttcgggggtggactaaggtttataacgttgggttaagtggaaggttagggtaaagtacggttactaaaacgttacttaagtcggacctaagggtacccgttaccgggtaagggtaaccgggggtacccgtaacgtttaacccgtaacccggttcccgttaaccggaaacggtaacggaaacccgtaaaaccgttaaccccgaaaacggaaacccgtaacccggtaccgttacggttaaacgtcccgttaacggaaccttaaacgtaccggaaacccgtacggtaacccgttacgaacgggtaacccggacccgggtaaaccgggaccggtaccggtacgtaactttaaccggttaactttaacggttagtccggtacgtaacggtaaacgggtaacgaccggtaccggtacccgtaacgg

SEQ ID NO: 265880 - DNA, 748 bp, Homo sapiens
  misc_feature: GYAE6OF02G3WN5.34.26.C04.1.454.CMB.1.raw
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttctttttaagaggtgtccagtgtcaggtncagctggtggagtcgtgggggagcgtggcccagcctgggctccngagcctctctgngcagcgtctggattccaccttcagttacgtcagtggactagtcgacacgtcgggtcccgccgaggcctaccggagggacgaaggggtctaggggaggtgggggtcgactaggttaacgtagttagggtagttggaagttagggaaagtttacggtactaaacgttactaggtacgtactaacggtaccgttccgggtaacggaacggggtacctacgttacccgtacccggttaccgtaacccgaaggtaacccgtaaacccgtaaccgtaaccccgtaaaacggaaacccgtaccggtaccgttacggttaacgttaccgtaacggtaacctaaacgtaccgaacccgtacggtaccgttacgggaaacggaccgggtaacccggaacgggtaccgtaccggtacgttaacggttacggtttaaacgttaccggtacggttacggaacggtaacggtaacggtaaccggaaccggtaccgtacccgtaaccgg

SEQ ID NO: 265881 - DNA, 599 bp, Homo sapiens
  misc_feature: GYAE6OF02I6KM3.34.26.C04.1.454.CMB.1.raw
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (364)..(364): a, c, t, g, unknown or other
  misc_feature (364)..(364): n is a, c, g, or t
  modified_base (494)..(494): a, c, t, g, unknown or other
  misc_feature (494)..(494): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttccncgttgctcttttaagnggtgtccagtgtcaggtgcagctggtggagtcgtgggggagcgtggcccagccgtgggaccgtccctggagacctctcctgtgcagtcgtctggattcaccttcagtagtcatggcatgcacgtgggtccgccaggcctcgagggccaaggggctgggacggtggggtcgctagttatagtggtangagtaggagtagtacaatacgtatgtacagtacgcgtgggaacggtccgattaccgtaccgtcgtaccgacgacgacaacgtacccaagaaccgaccgtcgtacgtactcgtacgactaacgtcgaaccncgtaccgtagacgtaaccggaccggacggaaccgacggtacctacgttaaggttacttaaccggtgttacggagtacggaaggacggacgaccgtccctaacggg

SEQ ID NO: 265882 - DNA, 776 bp, Homo sapiens
  misc_feature: GYAE6OF02F1V75.34.26.C04.1.454.CMB.1.raw
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcggttgccttacgttttaaggaggttgtccagtgtcaggtgcagcgtggtggagtcggtgggggagtcgtcggcccagccgtggggacctcctggacgtcttctccgtggtcgcgtaggccgttcgtggtacttccaccgttcgagtagtctagtcggactgtacgccgtacggtcggtaccnccgtaggtcccgtacgagggaccggagggtctaggggtggtgggtcgacgttaaggttacgtaggtacggtaatacgaggttaacgggaattacgaaacttagtactaggacgtaccgaacggtcccggttacggtaacgggacccggtactaccgttacccgtacccggttacaaccggaaacgtaacccgtaaacccgtaacggttaaaaccccaaagtaacccgtaccggttaactttacggaaccgtaccgttaaccgggaaacttaaccggacccgtaaacgtccgtaccggtaaggaaccgggaaccgggtaaaccgggacggtaacccgtaacggtttacgttaccgttaacggttttaaccggtcgtacgggttacgaacgggtaacgtaaggtaacccgaccgtaccgtccggttaaccggg

SEQ ID NO: 265883 - DNA, 538 bp, Homo sapiens
  misc_feature: GYAE6OF02G9HRX.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcaacgtctggattcaccttcagtagtcatggcatgccacgtgggtccnccaggctccgaggcaaggggctgggagtgggtgctagttatagtggtatggatgggaagtgtcaaatactatgacagactccgtagacgggccattccaccgtctccagacacaactcccaaagaccacgctgtactcgtagactaaatcgaaccacgacctagacgacgccgagaccacggactaagtcgtacttacgtggtagacgaggacgagaccgacggtccacgtacgg

SEQ ID NO: 265884 - DNA, 623 bp, Homo sapiens
  misc_feature: GYAE6OF02GUBGW.34.26.C04.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccatggagtttgggctgagcttgggttttcctcgttgcttctttttaagaggtgtccagttgtcaggtgcagctggtggagtcgtgggggagcgtggcccagccgtgggacgtccctggagacctctctgtgcagcgtntggacttctaccttnagtatcagtggacatgactacgtcgggtccgaccgacggcctaccgagggaccgaaggggctagggagggttggggtgacgtaggtttaatagtggttatggtagtacgggaaagttagtaactaagttacgtagtcggacacgtaccgtaccggtaaggacgggtacgttacttaccgtacccgtctaccgaagaaccgaacctaacgtaacccgaaacgaacgacgtacgttagtacgtacgtagactaagtacgaccacgctagacgacgacgacgacgacgtacgtagtacgtaacgtacgtgtacgagtaggacgaagacgacgacccgtacg

SEQ ID NO: 265885 - DNA, 646 bp, Homo sapiens
  misc_feature: GYAE6OF02IOQC5.34.26.C04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttctttaagnggtgtccagtgtcaggtncagctggtggagtcgtgggggagcggtggacccagccgtgggaccgtccctgacgactctcctggtcgcaggcgtctggtacttccaccttcagtcgtacagtcggacagttcgctacgtcgggtccgacgtcggctcccggagggtacccgaaggggtcctagggcggtgggggtagactaaggttagtagtaggtagaggtaagttagggaaagttacggtactaaagttacgagttcgacgtaacgtcgtaccggtaggacggaccgtactccgaccgtactaccgaagtacgaaccaacgttacccgaaagaaccagtcctaagtacgtaccgtagaacaacgacgtaaccacgctaacggacgtaccgacgaacggacgtacgacgttagtacgttaatacgttacggtcggacgaacggtaggaaccgactaccgaccgtaaccg

SEQ ID NO: 265886 - DNA, 643 bp, Homo sapiens
  misc_feature: GYAE6OF02G41NI.34.26.C04.1.454.CMB.1.raw
  modified_base (358)..(358): a, c, t, g, unknown or other
  misc_feature (358)..(358): n is a, c, g, or t
  modified_base (417)..(417): a, c, t, g, unknown or other
  misc_feature (417)..(417): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgctcttttaagaggtgtccagtgtcaggtgcagcgtgggtggagtcggtgggggaggcgtgggcccagccgtgggaccgtccctgacgactctcctgtgcagcgtctggtattaccaccttcagtagtcagtggcatgcacgtcgggtcccgccgaggccctccgaggccggaaggggcgtagggaggtggggnggcgtagtttacgtagtgggtaatggtagtagggtaaagttacgtacgtaaatacgtancggtacacgtaccgtaccggtagggaacgggaccgtacgttaccctacccgtcgtacccgaagtaacgaacctaaacctaacccgaaacgtaacccgaccgtacgttaacgtaccttacgtaccgtaactaaacgtacgtaacccgacgtaccgtaggacgacggacgtacggaccgtacggtacttagtacgttagtacgtcgagacgagagacgacacgctacg

SEQ ID NO: 265887 - DNA, 659 bp, Homo sapiens
  misc_feature: GYAE6OF02IF647.34.26.C04.1.454.CMB.1.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (279)..(279): a, c, t, g, unknown or other
  misc_feature (279)..(279): n is a, c, g, or t
  modified_base (619)..(619): a, c, t, g, unknown or other
  misc_feature (619)..(619): n is a, c, g, or t
  modified_base (627)..(627): a, c, t, g, unknown or other
  misc_feature (627)..(627): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgcttctttaagaggtgtccagtgtcaggtncagctggtggagtcgtgggggagcgtggcccagcctgggacctccngagactctcctgtncgngcgtntggtacttccacccttnagttagtcagtcggcagtgcctacgtcggggtccaccgaggtcctaccggaggcgaaggggctagggtagtggggtagacgtagttaataggtggtaatggaagttacgggaaagtacgttaacaaagttactgcggactacggtaccgtacggtacgggaacgggtaccgtaacctaccgtacccgttctaccgaacggaacgtaaccgtaaaccgtaaccccgaaaacgaaccgtaacgtaccgttacgtacgtcgtacgaacctaaacgacgaaccgtacgaccgtaacggacggaccgccggacggacgtaccggtattacgtagttacgttacgnggtaacgnggtaacggacgtaacgaccgaccgacctacgg

SEQ ID NO: 265888 - DNA, 581 bp, Homo sapiens
  misc_feature: GYAE6OF02GBTLZ.34.26.C04.1.454.CMB.1.raw
  modified_base (259)..(259): a, c, t, g, unknown or other
  misc_feature (259)..(259): n is a, c, g, or t
  modified_base (306)..(306): a, c, t, g, unknown or other
  misc_feature (306)..(306): n is a, c, g, or t
  modified_base (355)..(355): a, c, t, g, unknown or other
  misc_feature (355)..(355): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgctcttttaagaggtgtccagtgtcaggtgcagctggtgagtcgtgggggagcgtggcccagcctgggaccgtccctgacgactcctccgtgngcagcgtctggattcaccttcagtagtcatggcatgcacgtggtccncaggctccgaggcaaggggctgggagtgggtggctagttatagtggtanggtatgggaaagtacgtacaaatacgtaagtgaccaagtacctccgtaggaaacgggccgtaacgttccgaccgtctaccgaaggacgaaccaatacccgaaagaaccgacgactgtactctagaccaaagtcgaaccgtagacctagaacgacgtaccggaaggacgacgggactaacgtcgtaagttacgtagtacggacgtaagagtagacgtacgcctaacg

SEQ ID NO: 265889 - DNA, 867 bp, Homo sapiens
  misc_feature: GYAE6OF02GGXIX.34.26.C04.1.454.CMB.1.raw
  modified_base (809)..(809): a, c, t, g, unknown or other
  misc_feature (809)..(809): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcttgggttttcctcgttgcttcgttttaagaggtgtccagtgtcgaggtgcagtcgtggtgagtgtgggggagcgtggcccagccgtgggactcccgtgagactctcgtgtcgcagtcgtctggacttaccacgttcaggtagtctagttcggactagtcggtacctcggttcggggtcccgaccgtacgggtcctaccgaacggggaccgtaaaaggggggttcgtacgggggtaacgggtttcggggggtacgggtacccttaaagggtttaataaggggttaaccgggtaagttaggaaagggtttaaggggaaaaggtttagtaaccgttaaaagtaaacgttacggtacgaaccgttaacggtacccgtacccggggtttaaaggaacccgggggtacttaaacccgttttcccgggaaaccccggtttacccaccgggttaaacggaaacggtaaacccccgttaacgttaaacccccggaaaaacggttacccggaaaccgttccggtttagggttaaccttccgggtaaactaaaccgtaaaccggttacccgaaacccgtaaccggtcccggtaagtaacccggtaaggggaccccgtaaggggacctacggggttaacttaacggttttaacggtaaccttttaacggngggttacccggagggaaaccggtaaggaacccgtcccgtaaggacccgttaaacccgg

SEQ ID NO: 265890 - DNA, 681 bp, Homo sapiens
  misc_feature: GYAE6OF02GX8LB.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggttgtccagtgtcaggtgcagctggtggagtcgtgggggagcgtggcccagccgtgggactccctgagctctcctgtgcagcgtctggattccacctttcagttacgtcagtggcagttgcctacggttcggggtcccgaccgtaggcctcccggagggccggaaaggggtcgtagggagggttcgggggtagcgtaacggtttatagtacggtatggagttaggaagtagtactaattaacgtgacgtacaacgtaccgtcggtaaggacggtccgtaacgttaccgtaccgttcctacgaacgtaacggaacctaaacgtaacccgaaaggaaaccacgtaccgtgttaactcgtacgaaacctaaagtccgaaccgacgtaccgtaacggaacgaaccggccgaacgggaaccgtacggtaacgttaagttacgttaacgttacggtacggtacgtaacgggagtaacggtaaccggaacgtaccggacctaaccggg

SEQ ID NO: 265891 - DNA, 782 bp, Homo sapiens
  misc_feature: GYAE6OF02JK15P.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagaggttgtccagtgtcgaggtgacagcgtggtggagtcgtgggggagtcgtggcccagtccgtcgggacgtccctgagacctcgtcctggcgacgacggtcggttctagggtactttcccaaccgtttcgaacggttagtcgtactcgggctaagttccgaccgtacggttccgggttccccgacccgaaggggtccctacccggaaggggacccgggaaaggggtcccggttagggggacggtttacgggggcgggtaccgtaaaggtttaagtttaggtagggtttagtacggtaagttaacgggtaaaggtacggtttacaaaagtttaactaacggtgtactaacggacgttccggaagggtaccgggtaccgacgtttaccgaccggtcctacggacgaaacgaccgtaaacctaaccgtaaacgaacgtaccgacgttacgactcgtagaacgtaaacgttaccgaccgacggttaccgagggtaaacgacccggaccgaacggtaccgaacggtccgttaaacggttacgtttcggtaacgttcggacgtaacggacgggtaaccggaagtacccgggtaccgtacccgtaaccggg

SEQ ID NO: 265892 - DNA, 741 bp, Homo sapiens
  misc_feature: GYAE6OF02JTI0K.34.26.C04.1.454.CMB.1.raw
  modified_base (215)..(215): a, c, t, g, unknown or other
  misc_feature (215)..(215): n is a, c, g, or t
  modified_base (300)..(300): a, c, t, g, unknown or other
  misc_feature (300)..(300): n is a, c, g, or t
  modified_base (389)..(389): a, c, t, g, unknown or other
  misc_feature (389)..(389): n is a, c, g, or t
  modified_base (437)..(437): a, c, t, g, unknown or other
  misc_feature (437)..(437): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgcttcttttaagaggttgtccagtgtcgaggtgtcagtcgtggtacggngtcggtgggggacgcggtcgggcccaggtcccgtgggacccgttccccgtggacgtaccctccgttccgtgtcgacacggtcgtnttggtacttccacctttcgagttagtcgagtcggctatcggtacccgcgtcgggtacccgccaaggccgttccgagggaccggtagggngtacgggtggtcggggtacggctaacggttattacggtggtttaaagngtaacggttacggtaaagttaacggtactaaagttacgtgacgtacgacgttaccgtacggtacggacgggtaccgtacgtaccgtaccgtaccgttacaggtaaccgtaccaacgtaaaccgaaacgtaacgaccgtacgttacgtacgtacgtaaccgaacgtaacgtaccgaccgtaacggtccgtaacggaacggaaccgaccggaacggaccggttaccggtacgttaacggttaacgttacgttacggttacggacgttacggaaggtcggaaaccgccgttaccggaccgtaaccgg

SEQ ID NO: 265893 - DNA, 620 bp, Homo sapiens
  misc_feature: GYAE6OF02GLOO6.34.26.C04.1.454.CMB.1.raw
  modified_base (321)..(321): a, c, t, g, unknown or other
  misc_feature (321)..(321): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtggggggagcgtggcccagccgtgggacctcccgtgacgacctctcctgtcgcagcgtctggtacttccacctttcgagttagtcagtggcatcgctacgtcgggtcccnccgaggcctaccgagggcgaaagggggctagggtacggtggggtcggacgtagtttatagtgggtatgagtaggaatagtacaatatatgacagacgtccgtagacggacgtatccgaccgtctaccgagacgacaactacccgaaagaaccgaccgactagtactcgtacgactaacgtacgaccgacgtaccgtacggacggacggacccggaacgggaccgaacgggtactaacgttaagttacgttaacgtggtacggacggaggtaacggaacgaccgtaaccgacctaaccgg

SEQ ID NO: 265894 - DNA, 753 bp, Homo sapiens
  misc_feature: GYAE6OF02HB84V.34.26.C04.1.454.CMB.1.raw
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagtacacgtgatcacgaccggtgctcgatttagtctagcgactttggggtttgggggtcgtggggagaggacgcccagccactagaggtcggcggtgtttccattcggtgatcagtcactagaacacagaggactcacctataggtaggtttgggctaggagtcgtggggttttcctcgttggcttacttttaaggaggtcgtcctaggtgtcgaggtgcaggcgtgggtggagttcggtggggggagtcggtggcccaggccgtgggaccgtccctggacgacttccgtccgtggtcgcgagcgtctggattcctaccttcagttagtcagtggctagtcgcacggtcgggtcccgccgagggccctccgagggtaccggaacggggcgtagggngggtgggggtggactagttatagtaggttanggtagtagggtaagtacgttaagaaacttacgtagtgtaactaggaccgttaccgggtaggaacggggtacctacgttccgtaacccgtctaccgaaggtaccgaaacgtaacgtaacccgaaacggaaacctacggttaccgttaggtaacctttgaaccgtaaacctaaacgttacgaacccgtacgaccgtaagggtaacggaccgggacccgggaacggtaccggaccggtaaccgttaaggtttaaccggttacgttaacggttcgggtacgttaccggggaagtaacggggactaacccggtacggcccgtaaccggg

SEQ ID NO: 265895 - DNA, 614 bp, Homo sapiens
  misc_feature: GYAE6OF02JR8IG.34.26.C04.1.454.CMB.1.raw
  modified_base (177)..(177): a, c, t, g, unknown or other
  misc_feature (177)..(177): n is a, c, g, or t
  modified_base (322)..(322): a, c, t, g, unknown or other
  misc_feature (322)..(322): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (565)..(565): a, c, t, g, unknown or other
  misc_feature (565)..(565): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagccgtgggacctcccgtgacgaccttcctccgtggtgaccagccgttctaggattccaccttgagtagtcagtcggcagtgcacgtcgggtcccnccgtaggcctccgaggcgaaggggctgggaggttggggtcgcgtaagtttatagtggtatgtaggtaggaagttgactaagtntangacagtacctccgggaggacgggtacgtacttaccgacccgtctaacgtacggaaactaaccgtaacctaaccgaaacgaacgtaccgcttacgttaacgcctacgaacaagttaccgaactacggctaacgagtaccgccgaagacgcgtaacgtntaagttacgtacgtggtagaccgtaggaagccgaacgaccgacctacgg

SEQ ID NO: 265896 - DNA, 670 bp, Homo sapiens
  misc_feature: GYAE6OF02F9ZET.34.26.C04.1.454.CMB.1.raw
  modified_base (164)..(164): a, c, t, g, unknown or other
  misc_feature (164)..(164): n is a, c, g, or t
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagtacacgtgatcacgaccggtgctcgatttagtctagcgactttgggtttgggggctgggagaggaggcccagcactagaggtcggcggtgtttccattcggtgatcagcactgaacacagaggactcgaccatggagtttgggctgagctgggttttccncgttgctcttttaacgaggtgtccagtgtcaggtcgcagctggtggagtcgtgggggagcgtggcccagcctgggactcccngagactctcctgtcgcagcctcgtggaatttccaccttnacgttagtccaattggccaatcggcacgtcggggtcccncgaaggtcctccgagggtcaaagggggccttaggggacggtggggtcggcctaaggtttacgtaagtggggttaactgggacgttgggaaaacgttacgtactaaacgttactagttcgacctaagtaccgttccggtaagaccggggtcctacgtttccgaaccgttcgtaccaagtacgactaactcccgaaagtaccgaacgtcgtacgtacgttcgacgactaaacgtcgaaccgagtaccgtagaacggtacgtcccggaagggaccctaacgggtctttaacggtggttaaaccttacgttacggtggaacgtaggacgtacgaacgacggtaccaccgg

SEQ ID NO: 265897 - DNA, 753 bp, Homo sapiens
  misc_feature: GYAE6OF02F4TEN.34.26.C04.1.454.CMB.1.raw
  modified_base (177)..(177): a, c, t, g, unknown or other
  misc_feature (177)..(177): n is a, c, g, or t
  modified_base (253)..(253): a, c, t, g, unknown or other
  misc_feature (253)..(253): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtgggggagcgtggcccagcctgggacctcccgtgagctcgtcngtacgctagccgttcgtggtactttcctaccgttcgaaggttacgtccagtcgggcaagttcgccacggttggggtaccccgccgagggtcctacccggaaggccgtaaagggggctttgggggacgggttcgggggtacggccgttaaggttttaaagttacgtcgggggtttaatacgggtaagttaggggtaaaacggtttgtaaactaaacgttaaccgttagtacggtaccgtaaacggttaccgttcccggtaagggtaaccggggtccgtaacgtttaccggtaccccgttaccgtacccgtaaaggaacgtaaacctaaaccgtaacccgaaacgaaaccgtaccgtacgttacggtacttcgtaacgacctaaacgtacgaccgtacgtaccgtagacggtaacggaccgaacggaccgtaacgggccttaaggtacgttaacttaccgtaggttcggacgtaggaccggtaagaccgtacgccgtaacgg

SEQ ID NO: 265898 - DNA, 758 bp, Homo sapiens
  misc_feature: GYAE6OF02GY0W5.34.26.C04.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (445)..(445): a, c, t, g, unknown or other
  misc_feature (445)..(445): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaggnggtgtccagtgtcaggtncagcgtggtggagtcgtgggggagcgtggcccagccgtgggactcccnggacgactcctcgtgngcagcgtctggactttccacttcgagtagcagtggcagtcgcctacggtcgggtcccgccgtaggtcctccgaaggcggtaagggggctaggggtacggttgggggacgtacgtaaggtttaacgtagttaggtaagtggtaaaggttaggtaaaacgttacgtaactaaaacgttattacgngacgtaacgtaccgtaccgggtacgtaacgggaccgtaacgttacccgtacccgtacgtacccgaaaggaaccgtaaaccgtaaacccgtaacccgaaaacgtaacccgtaacggtaccgttacgttaaccgtccgtaacgtaaaccgtaaaacgtaccgaacccggttacgtaccgggttaacggaacgtaaccgggtaacccggaaccggtaaccggtacggtaacccgtttaagttaacggtttaccgttaaacgtcggtacggaacggtaacggtaacggaacggtaaccgtaccggtaccgtaaccgg

SEQ ID NO: 265899 - DNA, 713 bp, Homo sapiens
  misc_feature: GYAE6OF02GVI3Q.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggttgtccagtgtcaggtgcagctggtggagtcgtgggggagcgtggcccagcccgtgggacgtccctgacgacctctcctgtgacagcgtctaggacttccacctttcaggtatccatcggctagtgcctacgtgggtcccaccgaggcctaccgaggaccgaaggggtcgtagggacggttggggtgacgtaggtttactaggttcggttagtgtaggttacggtaaagttacgttacaaaagttacctaggtgaccgtaagtacccgttcggtagggaaccgggtccgtaactttcccggaccgttacgacccgtaagggaaccgaaccgtaacgttaaccccgaaagtaaccgtaccgacttagttaacttcgtacggtaactaaaccgtcgaaacccgtaacggcccgttaaagggacggacggtaaccggaacggtaccaacggtcgttaacgtacgtttaaccgttacggttaccggtaaggtaaccgttaaggaaccgaaccggtaacgtcccgtacgtaacccggg

SEQ ID NO: 265900 - DNA, 643 bp, Homo sapiens
  misc_feature: GYAE6OF02INVV0.34.26.C04.1.454.CMB.1.raw
  modified_base (179)..(179): a, c, t, g, unknown or other
  misc_feature (179)..(179): n is a, c, g, or t
  modified_base (321)..(321): a, c, t, g, unknown or other
  misc_feature (321)..(321): n is a, c, g, or t
  modified_base (406)..(406): a, c, t, g, unknown or other
  misc_feature (406)..(406): n is a, c, g, or t
  modified_base (500)..(500): a, c, t, g, unknown or other
  misc_feature (500)..(500): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcgttgcttctttaaagnggtgtccagtgtcaggtgcagctggtggagtcgtgggggaggcgtggcccagccgtgggaccgtccctgacgacctctcctgtgcagcgttctggtacttccaccttgagtagtcagtggcatcgctacgtcggggtacccncgaggcctaccgagggcgaaacggggcgtagggacgggtggggtcggactagttagtagtagggtataggagtaggaaagtatanaaacttacgtagtcgacgacgtacccgtcgaggaaacgggtcctaacgtccgaaccggtctacgaagaagaccaaaacgtacccgaaacgaacnccggtactagtacctgaacaactaaacgccaacgacgtcctaagggaacgaacggacccggaaggacccgaacggttactaacggttacgttagtttaaccggtagaggtaccgaaggacgtaacgacgtaccgcctaaacgg

SEQ ID NO: 265901 - DNA, 738 bp, Homo sapiens
  misc_feature: GYAE6OF02H14VJ.34.26.C04.1.454.CMB.1.raw
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (722)..(722): a, c, t, g, unknown or other
  misc_feature (722)..(722): n is a, c, g, or t
tcagtacacgtgatcacgaccggtgctcgatttagtctagcgacttttgggtttggggctgggagaggagcccagcactagaggtcggcggtgtttccattcggtgatcagcactgaacacagaggactcaccatggagtttgggctgagcttgggttttcctgttgcttcttttaagnggtntccagtgtcaggtgcagcgtggtggagtcgtgggggagcggtggcccagccgtgggacctcctgacgcctctccgtgtgcaggtcgtcgtggtacttccacctttcgagttagtcaagtggactagtcgctacgtcggggtcccgaccgacgggtcctacccgaagggtaccggaaacggggggtccgttagggggtaacgggttggggggacgggtacgttaacggttttaagtaaggttgggtttaaacgtagggtaggttaacgggtaaaaggttacgttaactaaacgtttaactaagtaccgacgtaacggtacccgttaccgggtaagggaaccggggaccgttaacgtttccccgtaaccgttccgtaaccgaaggaaccgtaacctaaaccttaacccgaaagaaaccgtaccgtctagtacttacgtaacgaacgtaaagtacgaacccgacggtacccgtaggaacggaacgaccgggagaccgacgtacgtagttacgtacttacgtagtagacgaaggtacggaacncggtaccgcctaacgg

SEQ ID NO: 265902 - DNA, 989 bp, Homo sapiens
  misc_feature: GYAE6OF02IYHGV.34.26.C04.1.454.CMB.1.raw
  modified_base (196)..(196): a, c, t, g, unknown or other
  misc_feature (196)..(196): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcgttttaagaggtgtccagtgtcgaggtncagcgtggtggagtcgtgggggagcgtcggcccagccgtgggacctcccgtagacgtacctcctccgtaggtcgccaggtcgtcgtggtaattccaccttgacgtagtccagtggactagtcggcgtaaccggttcggggtcccgaccgtacgggtcctaacccgggagggaacccgggtaaagggggtcccgttaggggtaacgggttttcggggggacggttaccgtttaaaggggttttaaagttaaggttttacggggtacgttaaggtaaacgggtttaaggggtaaaaacgggttttaaccgtaaacgtaaaacgtttaaacccggttagttaacgggtaacccggttaaacggttacccgtttaacccggggttaaacggggtaaaacccgggggttacccggttaaaccgttttaaccccgtaaccccgggtttacccgttaaacccggaaacggggttaaaacccgtaaacccggtaaaacccggttaaaccccgaaaaacggtaaacccgtacccggtttaccggttaaacccggttacgttaacccgtaacgggttaaaacccgtaaaaccgttaacccggaaccccggtttaaaccggacccgttaaaacgggtacccggaacccgggtaaaacccggcccgggaaaccgtttacccgggtaaccggtttaaacggttaaaccgggtttaaccgtttaacccgggttaggtaacccggtaaaggaacccggggttaaacgaacccgggttaaacgaccccgggttaacccttaacccgggg

SEQ ID NO: 265903 - DNA, 671 bp, Homo sapiens
  misc_feature: GYAE6OF02JMAFD.34.26.C04.1.454.CMB.1.raw
  modified_base (182)..(182): a, c, t, g, unknown or other
  misc_feature (182)..(182): n is a, c, g, or t
  modified_base (310)..(310): a, c, t, g, unknown or other
  misc_feature (310)..(310): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (384)..(384): a, c, t, g, unknown or other
  misc_feature (384)..(384): n is a, c, g, or t
  modified_base (662)..(662): a, c, t, g, unknown or other
  misc_feature (662)..(662): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagctgggttttcctcgttgctcttttaagaggtntccgagtgtcaggtgcagcgtggtggagtcgtgggggagcggtgcccagcctgggacgtccctgacgactctcctgtgcagcgtctggattcaccttcagtagtcatggcagtgaccagtcgggtccnccgngggcctccgaggcggaacgggtcngggtggtaggggtgccgtaagtttacgagttcggtagtagtaacgngggtaaagttagtactaaacgtaacggttatccggtaacacggtaccgttaccggttagggaacgggtaccgtacgttaccgacccgttcaccgtagaaccgtaacctaacaaccccgtaaaggtacccaacggtcttacgtactcgtagtaccgtaaagtacccgtaacgacgtacccgtggaaacgaaccggggagaacccgggacggacccgtacgtaaacggttcgttaaagttccctagggttacgtaggaacggaacgtacgaacggttacnccgtaacgg

SEQ ID NO: 265904 - DNA, 557 bp, Homo sapiens
  misc_feature: GYAE6OF02GC4G3.34.26.C04.1.454.CMB.1.raw
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaaggaggtgtccagtgtcaggtgcagctggtggagtcgtggggggagcgtggcccagcccgtgggaccgtccctgagacctctcctgngcagcgtctggattcaccttcagtgtcatggctatgcacgtgggtcccncgaggcctccgaggcgaaggggcctgggaggtggggtgactagttatagtggtatggagtggaatgtacaatactatgacagactcgtaggaggtccattccgacgttcacagacaccaanacccaagaccacgntagtatcagaactacganaccgacgtcctagaacgcgaccggacgtacgacggtacgtatacgttaacgttacgtgtacgacggtagacgtacggacctacggaccctaacg

SEQ ID NO: 265905 - DNA, 763 bp, Homo sapiens
  misc_feature: GYAE6OF02I73O9.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggcccagcctgggacctccctgacgtacctcctcctgtcgcagtccgtcgtaggtacttccacctttcgagtagtcagtggctatcgcctacggttcggggtcccgtccgaagggcctaccggagggcgtaagggggcctaggggaggttgggggtgctaaggtttagtaggttcggtagttggaggtacggtaaaggtacgtacaaagttacgtatcggacgtaacggtaccgttaccgggtagggtaaccggggtaccgttacgtttacccgacccggttaccgtacccgaaggtaaccgtaaacccgtaacccgttaaacccgaaaacggtaacccgtaacggtacccgtttacgtaaccgttaccgttaggaaaccgtaaacgtaccgaaacccggtacggtaccgtacgggtaaaccggaccgggtaccggaacgggtacccgtacgggtacgttaaacgtttacggttaactttacggttacggttaggaacgggttaggaaccggtaacggaccggtaccggtcccgtaaccgg

SEQ ID NO: 265906 - DNA, 685 bp, Homo sapiens
  misc_feature: GYAE6OF02JX8RV.34.26.C04.1.454.CMB.1.raw
  modified_base (180)..(180): a, c, t, g, unknown or other
  misc_feature (180)..(180): n is a, c, g, or t
  modified_base (349)..(349): a, c, t, g, unknown or other
  misc_feature (349)..(349): n is a, c, g, or t
  modified_base (488)..(488): a, c, t, g, unknown or other
  misc_feature (488)..(488): n is a, c, g, or t
  modified_base (670)..(670): a, c, t, g, unknown or other
  misc_feature (670)..(670): n is a, c, g, or t
tcagtacacgtgatcacgaccggtgctcgatttagtctagcgactttgggtttggggctgggagaggagcccagcactagaggtcggcggtgttccattcggtgatcagcactgaacacagaggactcaccatggagtttgggctagagctgggttttcctcgttgctacgttttaaagnggtgtccaagtcgtcaggtgctaggctggtaggagtcgtgggggacggcgtggccccaggtcccgtgggaccgtcctggacggacctcgtcctgtcgcgacggcgtcgtaggactttccgaaccttcgagttacgcctaggtggactagtcgacgacggtcgggtcccnccgacgggtcctacccggaagggtacccgaagggggtcctaggggttacggtcgggggttacggaccttaggtttaaactgtaacggggtataggtagtacggggtaaaatccgtaataaaagtactagtccggtaaancggtaaccgtccgggtaggaaacgggtccctaggtaccctaaccgtctaacccgaaggaacgaactaccgtacccaaagtacgaaccgtctagttacaacgtacgactaaagtacgtaccgatccgtagcgtaacgcgaggcaacggtcgtaatacggtataccgtgtgacggtagaaccgngacccgtgtactcgg

SEQ ID NO: 265907 - DNA, 684 bp, Homo sapiens
  misc_feature: GYAE6OF02JHAFL.34.26.C04.1.454.CMB.1.raw
  modified_base (161)..(161): a, c, t, g, unknown or other
  misc_feature (161)..(161): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgctctttaagaggtgtccagtntcaggtgcngctggtggagtcgtgggggagcgtggccagccgtgggacctccctgagacctctcctgtgccagcgtctggaattcgacttcagtagtcagtggcatgcacgtcgggtcccgtcaggcctccgaggcgaagggggtctagggacgtggggtgacgtagttatagtggtatggagtacggaaggttacgtaccaaagttactagtgaccgaaggtacctaccggtagggaacgggtacccgtagttcccgaaccggttctaacccggtaagaaccggtaacaaccgttaacccgaaaacgaaacctacccggtacgttaacgtaaccgtgttaaccgaccgtaaaacgacgtaacccgaacggttaccccgtaaggaaccggtacggaccggtaacggaccgtaccggtacgtaacggttacggttaactttaccggttagaccggtaacggtaacggaacgtaccggaacgtaccggacccttaacgg

SEQ ID NO: 265908 - DNA, 637 bp, Homo sapiens
  misc_feature: GYAE6OF02FN2OO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgctcttttaagaggtgtccagtgtcaggtgcagctggtggagtcgtgggggaggcgtgggccccaggcctgggacctcccgtgagacctctcctgtgcagcgtctggattccaccttcagtagtcatggcagtgcacgttcgggccgccgaggcctaccgagggcgaaggggctagggaggtggggtgcgtaggttatgtggtatggtagtaggacgttagtactaaaagttaccgtagtcgacgtacgtacccgttcgggtaagggaaccgggtacgtaacgtttaacccggtctaccgagaacgacctaactacccgaaagacctacgcttagtactacgtacgaaactaacgacgaacccgtacggcccgtagaacggtaccggaaccggacgggaaccgtacggacttagtagtaaccttacggtggtacgaacgaggtacgaacgaccgacgtaccgtacgtaacgg

SEQ ID NO: 265909 - DNA, 643 bp, Homo sapiens
  misc_feature: GYAE6OF02HOCVL.34.26.C04.1.454.CMB.1.raw
  modified_base (177)..(177): a, c, t, g, unknown or other
  misc_feature (177)..(177): n is a, c, g, or t
  modified_base (260)..(260): a, c, t, g, unknown or other
  misc_feature (260)..(260): n is a, c, g, or t
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaagnggtgtccagtgtcaggtgcagctgggtggagtcgtgggggaggcgtcggacccagccgtgggacctcctgacgtctctcctgngcagcgtctggtacttcaccttnagttacgtcagtggacatcggcacggttcggtcccgcgaggcctccgagggcgaaggggctagggacgggtggggcggtctaaggtttataggtcggttagtcgaagggttacggtaaagttacgttacaaagtttactagtcgtacgacgtcgtaccgggtaggtaaccgggtcgtaacttaccgacccgttctaccgagaaccgtaaccaaccgtaacccgaaagacctacgcgttagtactcgtacgaactaacgtccgaacctggaccctaggaacgtccggaccgacggtaccgacgtacgttagttacgttacgttactggtacgaggacggacgacgtacgtacgacctacgg

SEQ ID NO: 265910 - DNA, 633 bp, Homo sapiens
  misc_feature: GYAE6OF02HJQWE.34.26.C04.1.454.CMB.1.raw
  modified_base (161)..(161): a, c, t, g, unknown or other
  misc_feature (161)..(161): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (615)..(615): a, c, t, g, unknown or other
  misc_feature (615)..(615): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgtgggttttccncgttgctcttttaagaggtgtccagtgtcaggtgcagctggtggagtcgtgggggagcgtcggcccagccgtggggacctccctgacgacctctccgtgngcagcgtctggtacttcgaaccttnagtacgtcagtggcatcgccgtacgtcgggtcccgacgacggcctaccgagggccgtaaggggctagggagggtggggtacggctaagttaagtagttaggtactggagtagggaaacgtacgttacaagttacgtagtacggacgtacgtacccgttacggacggaacgggacccttacgttcccgacgttccaacgtaggaacgaacaacgtaacccgaaagaccacgtctagtactcgtacaacgtaactcgaaccgtacgccgtagacgaacgaccgaagtaccgacggtactacgtagtaacgttccgtggtacgagacggaanaccgtacgacaccgtacg

SEQ ID NO: 265911 - DNA, 726 bp, Homo sapiens
  misc_feature: GYAE6OF02IERYJ.34.26.C04.1.454.CMB.1.raw
  modified_base (305)..(305): a, c, t, g, unknown or other
  misc_feature (305)..(305): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgctcttttaagaggtgtccagtgtcaggtgcagctggtggagtcgtgggggagcgtggcccagcctgggacctccctgagactctcctgtgcagcgtctggattcaccttcagtgtcagtggcatgccacgtcggggtccnccgaggcctaccgagggtccgaagggggtctgggacggtgggggtgaccgtaggtttaataggtgggtatcggagttacgggaaagttagtaccaaagttaactagtcgacaacggtaccgtttaccggagggaaaaccgggggtccctaagtttacccgtaccggttaccgtacccgaaaggtaacggtaacctaaacgttaaccccgaaaacgtaaccgtaacccggtcttacggtaacttccgttaacggaacctaaaaggtccggaaacccgtacgtacccggttaggaaacggtacccggaacccgggaaggacccgtacccgggtacttaaacggttacggttaaaccggtttcctagggttacggaccggtaacgggttaaccggaacggaacccttaccggaccctaaccggg

SEQ ID NO: 265912 - DNA, 801 bp, Homo sapiens
  misc_feature: GYAE6OF02HWAT2.34.26.C04.1.454.CMB.1.raw
  modified_base (179)..(179): a, c, t, g, unknown or other
  misc_feature (179)..(179): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggttgtccagtgtcaggtgcagctggtggagtcgtgggggaggcgtcggcccaggccgtgggaccgtccctgacgacttctccgtgtcgcagtcgtcgtggtacttcaccttcagtagttcagttcggcagttcgccgtacgttccggggtccccgccgtaggtcctcccgaagggaccggaacgggggcttggggacgggttggggtcgggacgttaaggtttaagtaggttagggtagttggaacggtttaggtaaaggttaacgtaactaaagtttaacgtaagtcggtacctaagtaccggttccgggtaggaaaccgggggtaccctttaacggtcccgtaacccggttaccgttacccggaaacggtacgtaaaaccctaaacgttaaacccccgaaaaggtaaacccgtaccggtacgtttaacgtaaacttccggttaacgaaaccgtaaaacgttccgaaacccgtacggaccgtaagggtaacgaaccggggaacccgaacgggtacccgaacccgggtttacgttaacggttaacggtttaacgttcccgttagggtaccgggaaccggtaaggaaaccgggtaccgaacgttacccgggaacctaccggg

SEQ ID NO: 265913 - DNA, 543 bp, Homo sapiens
  misc_feature: GYAE6OF02GKBJ1.34.26.C04.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcacgtgggtcccnccgaggctccgaggcgaaggggctgggagtggggtgctagttanagtggtatgagtggaagtagtctaatctatgcagtacctcggtaggacgggtcgattcgaccgtctccagacgacaactacccgaaagaccacgtctagtactctcgacaagtcgaccacgacctaggaacgacgaccgaaggacacggtctaagttagtaacttacgtgtcgacgagagagacgacgacctacgg

SEQ ID NO: 265914 - DNA, 621 bp, Homo sapiens
  misc_feature: GYAE6OF02I51UN.34.26.C04.1.454.CMB.1.raw
  modified_base (303)..(303): a, c, t, g, unknown or other
  misc_feature (303)..(303): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgacgactctcctgtgcagcgtctggacttcaccttcagtgtcatggcatgcacgtgggtccncgaggcctcgaggcgaaggggctgggagtggggtgctagttatgtggtatgagtggaagtagtacaaagttactagtgaccgtaacgtaccgtaccggtaggaaacgggtcctaacgtttcccgaacccgttctacccgaggaacgtaacccaacttaccccgaaagaaccaccggtacttacgtaactcgtacgaactaaagtccggaacctacgccgtaaggacgaaccggaccgaacggaccgacggtacttaggttacgttaacgttacgtggtaggaccggtaggaacgtaacggaccacgtaccgtaaccgg

SEQ ID NO: 265915 - DNA, 680 bp, Homo sapiens
  misc_feature: GYAE6OF02IC20C.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtcgtccagtgtcaggtgcagcgtgggtggagtcgtgggggagcgtcggcccagccgtgggacctccctgacgactctcctgtgcagtcgttctggtacttcctacctttcgagttacgtacagttggactattcggaccctacggttcggggtccccgcgacggtcctccggagggaccgtaagggggcttaggggtaggtgggggtcgtacgtaggtttaacgtagttaggtagtggaagtagggtaagttacgtactaaattacgtaagtcgacgtacgtaccgtacggtaggaaaccggggtcctaagttcccgaccgttaccgtaccgaacgaacgtaacaaccgttacccgaaagaaccgaccgtacgttacgtactcgtagtaacgtaataccgaacctacgaccgtgaacggaccgaccggacgaccgtacggacttacgttaacgtacttacgtgtacggaggaacggacgtaacgactaccggacctacgg

SEQ ID NO: 265916 - DNA, 828 bp, Homo sapiens
  misc_feature: GYAE6OF02HV4BC.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagctggtggagtcgtggggggagcgtcggcccaggcccgtggggaccgtccctaggacgacctcctccgtggtcgactaggtccgttcgtagggtactttccaccttttcgaaggtttagtccgtaagtcggggtacctagttcggaccctaaccggttccgggggttccccgacccggaagggtccccttacccggaaggggtacccggtaaaggggggtccgtagggggtacgggttcggggggttacgggaccttaagggttttaagtacggttaggggttaagtagggtaaggtttagggaaaggtttacgtaacgtaaatttacgtagtcgacgtaacggtaccgttaccggggaggtaaaccggggcccgttaactttacccggtaccccgttaccgttacccgaaacgggtaaccgtaaacccgtaaaccgttaaccccgaaaagggaaacccttcccgggtactttacggtaaccttcggtaaccgtaacctaaacgtccgaaacccctacggtacccgaagggaacgaaccggaaccgggaaccgaaccgtcgggttactaaggttcgttaactacggtttagacggtcgggaagtaacgtacggactacccgtacctaccggg

SEQ ID NO: 265917 - DNA, 743 bp, Homo sapiens
  misc_feature: GYAE6OF02I27ER.34.26.C04.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggatttgggctgagctgggtttttcctcgttgctctttttaagaggtntccagtgtcaggtncagctggtggagtcgtgggggagcgtggcccagcctgggacgtccctgagaccttctcctggtcgcagcgtctgggattccaccttgacgttagtcattgggacctagcgtcgacgttggggtcccgtcacgggctcccgagggccgtaaagggggtccttgggaggttcgggggtacgtactaagtttacgtagtacggggttatacggtacgtaggtaaaggttacgtacctaaagttaccgtaatggtaacctcggtaaccgtacccggttagggaaccggggtcccgttaaacgtttccggtacccgtaccgttaccgaaggtaacgtaacccgttaaacgtacccaaaccggaaacggtaacccgagttaccgtaacgtccgtaccggaaccttaaaggtccgaaaccttacgcccgttaacggacgtaaccgtaccgggaaacgtaccgtaaccggtaccgttaacgttaacgttaacgtttaccggtaggttaccggtacggaacggtaaccgaacggtaacgtaccgtaccgtaaccgg

SEQ ID NO: 265918 - DNA, 742 bp, Homo sapiens
  misc_feature: GYAE6OF02I8I4W.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctggttttcctgttgcttcttttaagaggtgtccagtgtcaggtgcagctggtggagtcgtgggggaggcgtcggcccaggccgtgggaccgtccccgtggacgacctcgtccgtgtcgcgacgcgttcgtggtactttaccaacccgttttcgagttagtacagttcgggactagttcgacctaccggtcgggtccccgaccgacggtccctaccggagggaccggaaggggtcgttacgggtaggttcgggggtcgacgttaagtttaagtagttagggttaagttaggagttacggtaaggttaggtaactaattacgtagtcgaacgtacgtacgtccggtaacgggaaacgggttacctaacgttacccgtacccgttccgtaaccgaaggtaacctaacccgtaaaccgttaaccccgaaaaggtaacccgaccgttacttacgtaaaccgttcgtaacgtaaccgtaaaccgtccgtaaccgacgtacccgtagacggtaccgaccggaagccgtaacggtcttaagtacggttattaccggttggacgtacggaagtaaccggaccgtaacgtcccgaccgtacgg

SEQ ID NO: 265919 - DNA, 587 bp, Homo sapiens
  misc_feature: GYAE6OF02HRCTP.34.26.C04.1.454.CMB.1.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
  modified_base (576)..(576): a, c, t, g, unknown or other
  misc_feature (576)..(576): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtcggcccagccgtgggactccctgagactctcctgtcgcagcgtctggattcaccttnagtagtcagtggcatgcacgtgggtccncgaggcctcgaggcaaggggctgggagtggggtgactagttatagtggtatggataggaagttacgtactaaattacagtggaccaagtaccgtaccggtagggaacggggtcccgtacgttcccgaccgttcctaccgagacggaaccaacgttacccgaagaaccacgtactagtactntacgactaacgtnaccgagtccgtaagacggacggtaccgaggacgtacggtctaagtcgttaatcgtgtggacgagaacgaggaacncggacctacgg

SEQ ID NO: 265920 - DNA, 658 bp, Homo sapiens
  misc_feature: GYAE6OF02JJMU2.34.26.C04.1.454.CMB.1.raw
  modified_base (159)..(159): a, c, t, g, unknown or other
  misc_feature (159)..(159): n is a, c, g, or t
  modified_base (166)..(166): a, c, t, g, unknown or other
  misc_feature (166)..(166): n is a, c, g, or t
  modified_base (173)..(173): a, c, t, g, unknown or other
  misc_feature (173)..(173): n is a, c, g, or t
  modified_base (189)..(189): a, c, t, g, unknown or other
  misc_feature (189)..(189): n is a, c, g, or t
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
  modified_base (377)..(377): a, c, t, g, unknown or other
  misc_feature (377)..(377): n is a, c, g, or t
  modified_base (558)..(558): a, c, t, g, unknown or other
  misc_feature (558)..(558): n is a, c, g, or t
  modified_base (634)..(634): a, c, t, g, unknown or other
  misc_feature (634)..(634): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagttgggctgagctggtttccngttgctntttaagngtgtcagtgtcaggtncagcgtggtgtagtcgtgggggagcgtggccaggccgtaggggacctcccgtagacgacctccgtccgtaggtggcctacgggtccgtgtacggtacttacctacctttcgaagtcgttcagttcggacngtcgccgtaggtccgggtcccnccggacgctaccgagggacgtacggggtcgtagggngggtcgggtggacttagttacgtaggtaggtattagggaatttacgggagtttaacgactaagtaacgttgcgacgtacgtaaccggtacggacggtaaacggcgtactaccgtaccgtcgtacgacggtaacaactacctaccgaaataccggactcggtatctacgaacgaataaccgntacccgtagcgtacgaggtccgacgaacggtacacggttactaggctttaacggtacgtgacgggtacgaaacggngtaaacgccgtacgacctaacggg

SEQ ID NO: 265921 - DNA, 701 bp, Homo sapiens
  misc_feature: GYAE6OF02I2COE.34.26.C04.1.454.CMB.1.raw
  modified_base (280)..(280): a, c, t, g, unknown or other
  misc_feature (280)..(280): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggcccagccgtgggactccctgagactctcctgtgcagcgtcgtggtacttccaccttnagtagtcagtggcatgcacgtcgggtcccgccgaggccgtccagggccgaagggggtcctaggggcggttaggggtcggacgtaggttacgtagttcggggtaattggaaggttacggaaagttacgtacgtaaattacgttaatcggtaccaggtaaccgttccgggtaagggtaacgggtccgtaacgttccgtaccggttacctaccgtaagaaaccggtaacaacgtaacccgaaagtaacccgacgtacgtacgtaacgtcgtacgtaacgtaacgtacgaacccgtaagtaccgtaggaaccggttacggaacccggtaccgggacggaccggttacgttaacggtatttaacgttcggtttacggtacggtaccggtaaggtaacgaacggtacgtaacccggacgttaaccgg

SEQ ID NO: 265922 - DNA, 828 bp, Homo sapiens
  misc_feature: GYAE6OF02I1MZG.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgcttcttttaagaggtgtccagttgtcgaggtgcagcgtgggtggagtcggtgggggagcggtcggcccgaggcccgtggggaccgttcccgtaggacgtacctccgttccgtggtcgcgacggtccgttcgtaggtactttccctaaccgtttcgaagttacgtcgtagtcggctagtcgcgtacggttcgggtcccgaccgacggtcctaccggagggaccggtaaagggggtccgttaggggtacgggttgggggtcggtacgttaaggtttagttaggtaggttagtcgtaagggtagggtaaacgtttacggtaactaaacgttaacgttagtacgtaccgtaaggtaaccgttaccgggtaagggtaaccgggtacccgttaagttaccccgtaacccggttacctacggaaacggtaaccgtaaaccgtaacccgttaaacccggaaaagtaaccgaacccggttcttaaacggttaaccgtaccgttaaccgaaacgtaaaccgtaaaccgacccgtaacgtaccgtaacggggtaaccgaaccgggaacccgtaacgggacctaaccgggttacttaacggtttacgttaacggttaaccgtcggttaacggaccgggtaaggtaacccgaaggtaccgaccgtacccgtaacgg

SEQ ID NO: 265923 - DNA, 840 bp, Homo sapiens
  misc_feature: GYAE6OF02HXK64.34.26.C04.1.454.CMB.1.raw
  modified_base (161)..(161): a, c, t, g, unknown or other
  misc_feature (161)..(161): n is a, c, g, or t
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttgggctgagcttgggttttccncgttgcttcttttaagaggtgtccagtgtcagggtncagcgtggtagggagtcggtggggggagcgtggcccagccgtgggcctcctgacgtactctctgtcgacaggccgttcgnggtacctttacccacccgttttaccgaaggtttaacgtccgtaacggtcgggtactaacgttcggacccgtttaaccgggttccggggggttaaccccccgaccggtaaacgggggttccccgttaccccggaacgggggtacccgggaaaaggggggttcccgtaaggggggtaagggttcgggggggtcgggtaaccttaacggggttttaataaggggtttacggggtaactaagggttagggttaacgggtaaaaggttcggttaaataaaacgttacgtagtccggaaacgtacggtaaccggtaccgggtaagggaccgggtaaccgttacgtaaccggtcccgtacgtaccgaacggaacgtaaacctaaccgtaacccgaaacgtaaccgaaccggtcgtaacgttaaccttacgtaacggtaacgtaaacgtaccgaaccgtacgtaccgtacggaacggtacggaccggaccgaccgacggttactaacggttacgttaacgttcgtaggtacggtacggacgggtaacacggaacggtccgtaccgtaccgg

SEQ ID NO: 265924 - DNA, 740 bp, Homo sapiens
  misc_feature: GYAE6OF02GM640.34.26.C04.1.454.CMB.1.raw
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctggagcgttgggttttcctcggttgcttcttttaagaggtgtccagtgtcgaggtgcngtctggtggagtcgtggggggacgcggtcggcccaggccgtggggtaccgtcccgtggacgaccttccgtcctggtcgcgaggtccgttacgnggtactttccacctttgaagttacgtcagttcggctagtcggccgaccggttcgggggtaccccaccggacgggtcccttacccgggaggggaccggtaaaggggggtccgtagggggtacggggttcggggggtaggaccgttaaaggttttaagtaggttaggggtaattggaaggttagggtaaaaggttctacgtaaattacgttaggtcgacgtaacgtaccgtcgggtaaagggacgggtacctagttcccgtaaccgtctaccgaagtacgaaccaaccgtacccgaaagaccgtacgctacgtactcgacgaactaagtcgaacctacggcctaaggacgacgaccgggtaacgaccgtacggttctaaggttaacgttacgttccggttacgtacggacggtaagggaacgacgaaccggcggtaccctaacgg

SEQ ID NO: 265925 - DNA, 579 bp, Homo sapiens
  misc_feature: GYAE6OF02GOGAC.34.26.C04.1.454.CMB.1.raw
  modified_base (177)..(177): a, c, t, g, unknown or other
  misc_feature (177)..(177): n is a, c, g, or t
  modified_base (314)..(314): a, c, t, g, unknown or other
  misc_feature (314)..(314): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaagnggtgtccagtgtcaggtgcagctggtggagtcgtgggggagcgtggcccagcctgggacctccctgacgactctcctgtgcagcgtcgtggacttccacctttcagtagtcagttggcatcgctacgtcgggtcccnccgaggcctccgagggcgaagggggctgggaggtggggtcgactaggttanagttggtatggaagtggaagtntacaattatagtgacgtaagtccgtacggtaggaacgggtcctacgttaccgaccgttcaccgaagaacgacaactaccaagaacacgctgtactcgagactaacgtcgaaccgagtccgagacgacgaccgacggacgacggtcgaagttagttacgtacgtgtagacggaagagacgacgtacgactacg

SEQ ID NO: 265926 - DNA, 730 bp, Homo sapiens
  misc_feature: GYAE6OF02JUUH0.34.26.C04.1.454.CMB.1.raw
  modified_base (695)..(695): a, c, t, g, unknown or other
  misc_feature (695)..(695): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgcttctttaagaggtgtccagtgtcaggtgcagtcgtgggtggaggtcgtggggggaggcggtcggccccagcccgttggggaccgttccccgtggaacgaccttccgtccgttgtgacgacgccgtcgttggactttccgaccctttcgaggtacgtctagtcgggcattcggactaccggtcgggtcccgccgagggcctccggaacgggtcgaaaggggggtcctggggagggttccgggggtggacttacggtttaagtaggttacggtatgggtaacgtagggaaaactttacggtactaaaggtttactagtcggaaccgtaggaccgttaccgggtagggaaccgggtacgtacgttccgtaaccgtccgtacgaacgggtaacaaccgtaaaccgttaaccccgaaacgttaaccgacgtacctaggttaccgttacgtacgaaccgtaatccgaaccgttccgacgtcggaacgacggtaccgaacgttaccgacgtactaacgttagtacgtacgtagnggtacggaggaccgtaacgacggtacgaccgtacg

SEQ ID NO: 265927 - DNA, 651 bp, Homo sapiens
  misc_feature: GYAE6OF02I4U2B.34.26.C04.1.454.CMB.1.raw
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaaggaggtgtccagtgtcaggtgcagctggtggagtcgtggggggagcgtacggcccagcccgtggggaccgtccctggacgactctcctgtgccagcgtctggtattccaccgtttnaggttacgtctagtcggctagtgctagttcggggtccnccgaggcctccgagggcaaggggctgggagtggggtgactagttatagtggtatggatggaagttacgataagtactagtcgacagtacctcggtaggacgggtccgtacgttacgacccgtaccgtaccgacgacgaacctaaccgtacccgaaacggacctaccgcttacgtaactcgtactacaaacgtacgaacctacgaccgtaggtaccggacggtaccgacgggacctaccgggtaagttacgtttaggttaaacgtttcgtaacgggttacgacgggaggtaacggaaccggtacgacccggtaacctaccggg

SEQ ID NO: 265928 - DNA, 704 bp, Homo sapiens
  misc_feature: GYAE6OF02G722Y.34.26.C04.1.454.CMB.1.raw
  modified_base (276)..(276): a, c, t, g, unknown or other
  misc_feature (276)..(276): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccaggccgtgggacctcccgtgacgtacctccttcctgtgcaggtccgtntggattccacctttacgagtacgtctatcgggactagttcgaccgtaccggtcggggttcccccgacccgaacgggtcccgtacccgaaggggaccgaaaggggggtccgtaaggggtagggttcgggggttacggaccgttaaaggtttaacgtaaggttgggtaagtaggtacgttaagggtaaagttaacgtaccttaaataccgttagacgtacgaacgtaccgttcgagggacgggacctaacgttacgaccctctacgaaggaaccgtaaccaacgtaacccaagtaacccgacgtaacttcgtacgtacgaacgaacaaacgtaccggaactacgtcacggtaacaccgacgaccgacgtacgactaactaagttacgttaccgtggtacacgggtagaactacggaaccagaccctacgg

SEQ ID NO: 265929 - DNA, 681 bp, Homo sapiens
  misc_feature: GYAE6OF02JUUIS.34.26.C04.1.454.CMB.1.raw
  modified_base (224)..(224): a, c, t, g, unknown or other
  misc_feature (224)..(224): n is a, c, g, or t
  modified_base (611)..(611): a, c, t, g, unknown or other
  misc_feature (611)..(611): n is a, c, g, or t
  modified_base (650)..(650): a, c, t, g, unknown or other
  misc_feature (650)..(650): n is a, c, g, or t
tcagtacacgtgatcacgaccggtgctcgatttagtctagcgactttgggtttggggctgggagaggagcccagcactagagttcggcggtgtttccattcggtgatcagcactgaacacagaggactcaccatggagtttgggctgagcgttgggttttcctcgttgcttacgttttaagaggtgtccagtgtcgaggtgcagcgtggtggagtcgtgggggngccggtggcccgagccgtgggacgtccctggacgctctccgtggtcgctagccgttcgtaggactttccacctttagaacgttcgttacagttcggccattcgacgtacggtcggggtcccgaccgtagggtcctacccgagggacgggaacgggggtctggggtacgggtgggggttcggtattacggttaataggttggtaagtcggtaagtaggtaacgtacgtactaaatcgtaagtcgacgtacgtacgtccggtaggtaaccggcctacgttccgtaacccgtcgtacgaacgacgaactacctaacccgacgaaccacgtacttacggtacttaacgctaaccgtaacgtaccgaacgacctacgtaagaccgggtaacnccggaacggactcggtaacttcgtaattagtcgttacgnggaacgacggacacggaacgacgtcccgacg

SEQ ID NO: 265930 - DNA, 646 bp, Homo sapiens
  misc_feature: GYAE6OF02HRJTD.34.26.C04.1.454.CMB.1.raw
  modified_base (163)..(163): a, c, t, g, unknown or other
  misc_feature (163)..(163): n is a, c, g, or t
  modified_base (187)..(187): a, c, t, g, unknown or other
  misc_feature (187)..(187): n is a, c, g, or t
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (306)..(306): a, c, t, g, unknown or other
  misc_feature (306)..(306): n is a, c, g, or t
  modified_base (377)..(377): a, c, t, g, unknown or other
  misc_feature (377)..(377): n is a, c, g, or t
  modified_base (612)..(612): a, c, t, g, unknown or other
  misc_feature (612)..(612): n is a, c, g, or t
tcagtacacgtgatcacgaccggtgctcgatttagtctagcgactttgggtttggggtcgtgggaggaggagcccagcactagaggtcggcggtgttccattcggtgatcagcactgaacacagaggactcaccatggagtttgggctgagctgggttttccncgttgctcttttaagaggtgtccngtgtcaggtgcagctggtcgagtcngggggagcgtggcccaggccgtgggaccgtcctggaacgcttctccgtgtcgtacngcgtctggattcgaccttcagtagtccatggctagtcngacgtcgggtccgccacggtcctaccggaggcgtaacggggctagggaggtcgggtcgggctagttaacgnggttacggtaagtggtaagtgggaaagttacggtactaaattaccgtaagtgaccgtaaacgtccgttacggtacgaagggcccgttaaagtacctaccggttcttaaacccgagtaaggtaacaaacgttacccaaggaaaaccttcgaccgtagtactacgtcgaagtacgtacgacctacgcgtagacgaaggtcccgaagaccgtcgtgtaacgttactagttaacccggngtcgagaacggtacgaacgtaccgacgtccacgg

SEQ ID NO: 265931 - DNA, 711 bp, Homo sapiens
  misc_feature: GYAE6OF02GYIS8.34.26.C04.1.454.CMB.1.raw
  modified_base (370)..(370): a, c, t, g, unknown or other
  misc_feature (370)..(370): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtcggccagccgtgggaccgtccctgagtcctctccgtgtcgcgtacgcgttcgtggtacttaccgtaccttctacggttagtcagtcggctagtcgcgacgtcgggtcccgccgaggcctccgagggcggaagggcgtagggtagggnggggtcgacgtagtttactaagttggtataggtagtggtaaagttacgtataaagtctaagtgaactagtacctacggaggaacggccgttaacgttacccgtaccgttacgacccgtaagaaaccgtacaaaccgttaacccgtaaacgaaaccgtccgtacgttcgtaaagttccgttacgaaaccttaaacgtaccgaaccgaccgtaaccgtggaaacggaccggtaaccggaagtacccggaacggttacgtaacttaggtttaaccgttacggttacggtaccggtaacgggaacggtacgacccgggtaacgtacccggtaccgtaaacccggg

SEQ ID NO: 265932 - DNA, 869 bp, Homo sapiens
  misc_feature: GYAE6OF02H6HII.34.26.C04.1.454.CMB.1.raw
  modified_base (296)..(296): a, c, t, g, unknown or other
  misc_feature (296)..(296): n is a, c, g, or t
tcagtacacgtgatcacgaccggtgctcgatttagtctagcgactttgggtttgggctgggagaggagccccagcactagaggtcggcggtgtttccattcggtgatcagcactgaacacagaggactcaccagtggtagttgggctggagtcgttcggggtttttccctcgtttggtcctttacgtttttaaaggaggttcgtcccgtaggtgtcgtaggtgctagtcgttggtgggtagtcggtggggggaggtcggtcggacccgtacggcccggttagggtacccgttcccnggaaccgtccttccgtcccgtggtcgccgtacggtccggtcgttaggtacttacccgtaaccgtttcgtaaggttacgttaccgtacggtcggtaactaacgtcgtaaccgttccggtccgggggttacccccgaccggttacgggaccccgttaccggacggggtaacccgggaaacggggggtccgttagggggtaccggggtttcggggggtaggtaaccggtttaaacgttttagggtaaggtttaggggttaagtacggttaaagggttaacggggtaaaacgtttaacggtactaaaacgtttacgtaggttaacgacggtaaccgtaccgggttacggtacgggtaaccggtaccgttaacgtacccggtaccgtaccgtaacccgaacggtaaactaacccgtaaacgtaacccgaaacgtaacgtaccgttacgtagttaacgtacgttacgaaccgtacgtacgaaccgtacgtacgacgaacggaccgaacgaccgtacgtacgtcgtagttacttaagtccgttaaggtcggagacggtacgaacggactccgacgtacgg

SEQ ID NO: 265933 - DNA, 645 bp, Homo sapiens
  misc_feature: GYAE6OF02F0M6B.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggcccagccgtgggaccgtccctgagacctctccgtgtcgcaggtcgtccgtaggacttctaccttcagttacgtcagttggacagtcgccacggttggggtaccccgccgaggtcccgtccgagggcgaaagggggcgtagggaggttcggggtcggctaggttactagtggtagtgagttagggtaagtacgttacaaagttacgtagtggacctaggaaccgtcggttaaggaacgggtcctacgttccgtacccgttcgtaccgaagacgaacaactacccgaaagactaccgtcgttagtacttcgtacgaactaacgtacgaaccgacgccgtaaggacggacgaccggaaggaccgacggacttagtagttaacgtacgtggtacgacggaggtacggaagcgacgtccgtaacgg

SEQ ID NO: 265934 - DNA, 826 bp, Homo sapiens
  misc_feature: GYAE6OF02HL8OR.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagctggtggagtcgtgggggagcggtcggcccagcctgggacgtccctggacgacctcctcctgtcgcgagtccggtctggactttccaccttcgaggttacgtctagtggcctaatcgccgtacgttcggggtcccgccgaggcctccgagggcgaagggggtctagggagggtcggggtgcgtaaggtttaagtagttaggtaagttcggaaggtttagggtaaaacggttacgttaaactaaacgttaaacgttaagttacggtaccgaaccggtacggttaccccgggttaagggaaacccggggtacccgttaacgtttaccccgaaccggttacccgttaacccgaacggaaaccggtaaaccaaaccgttaaccccgaaaaccgaaacccggtaacccgttacggttaacgtttaaccttacccgtaggtaaacccttaaaacggttcccgaaaccccgttagaccccgtaaggtaaccggaaccgggtacccgggaacgggaacccgaacgggtaccgtttaaagttccgggtttaagtttaaccggttcgggttaacggtacccggggtaagtaaaccggggtaaccgaacccggtaacccggtccccttaaacccgggg

SEQ ID NO: 265935 - DNA, 592 bp, Homo sapiens
  misc_feature: GYAE6OF02JEHM8.34.26.C04.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
  modified_base (403)..(403): a, c, t, g, unknown or other
  misc_feature (403)..(403): n is a, c, g, or t
  modified_base (556)..(556): a, c, t, g, unknown or other
  misc_feature (556)..(556): n is a, c, g, or t
tcagtacacgtgatcacgaccggtgctcgatttagtctagcgactttgggtttggggctgggagaggagcccagcactagaggtcggcggtgttccattcggtgatcagcactgaacacagaggactcaccatggagtttgggctgagctgggttttccncgttgctcttttaagnggtgtccagtgtcaggtgcagctggtggagtcgtgggggagcgtggcccagccgtgggactccctgagacttctcctgtcgacagcggttcgtggtattccggtcctttcgagttacgtcagtcggctatcgctaacggtcgggtacccgcgaggcctccgaggacgaacggggctagggagtggggtgactagtatgtgtatgagtaggagtagtactaatcgtancgacgtagtaccgtcggtaggtaacggctacgttcgtaccgtcaccgagacacacgtacctaagacctagcgtatacgtcgtacgaacaacgtacgaccacggacctaggacgacgtaccgaagaccgcgtacgtattacgttacgttaacgnggtaggacgtacggagtacgacgtacgccctaacgg

SEQ ID NO: 265936 - DNA, 636 bp, Homo sapiens
  misc_feature: GYAE6OF02FMYJA.34.26.C04.1.454.CMB.1.raw
  modified_base (311)..(311): a, c, t, g, unknown or other
  misc_feature (311)..(311): n is a, c, g, or t
  modified_base (402)..(402): a, c, t, g, unknown or other
  misc_feature (402)..(402): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggcccagccgtggggacctccctgagactctcctgtgcagcgtctggattccaccttcagtatcatgggcatcgcacgttcggggtccncccgaggccctaccgaagggccgaaagggggtctgggaggtggggtggctaggttatagtggtatggaatgggaagttgtacaaatctagngccaagccgtacgtaggaacgggtccgtattccgaccgtctacccgaagacgaaccaagtaccccgaagtaaccgacgtcttacgtaattcgtacgaactaaagtccggaacccagtcccgtagaccggtaagcccggaacggaccgtaacggaccgtttaaagttaccgttaaactttacggttacgtacgggtagaaacgggtacgaacgtaacccgacggtccccgtaacg

SEQ ID NO: 265937 - DNA, 736 bp, Homo sapiens
  misc_feature: GYAE6OF02GRFYQ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgctcttttaagaggtgtccagtgtcaggtgcagctggtggagtcgtggggggacgcggtcggcccgaggtccgtacggggtacccgtcccgtaggaccgtaccttccttccgttggtcgacgacggtccgttccgtggtaccttccttacccttacgtaggttacgtactaggtcggactagtcgacctacggtccgggtcccgccggacggtccctaccggagggaccggaaggggtcgtagggtagggttggggtacgagttaagtttaagtaggttaggtagtacggtaaggttaagggtaaacgttagtaactaaattacgtagtcgaacgtacgtaccgttcggaagggaaccggtcttacgttacccaccgtctaccgaagaaccgaactaaccgtaacccgaaagtaacctccgagtttacgtactaccgtaagtaacctaagtaccgaacctaccgtacgtaaggaccggtaaacggacccgggtaacgacgttccggtacttaaagttcggtttaaacgtcggtagtaggacgaaggtagaccgaacgtccgtacctacgg

SEQ ID NO: 265938 - DNA, 637 bp, Homo sapiens
  misc_feature: GYAE6OF02ISSV5.34.26.C04.1.454.CMB.1.raw
  modified_base (278)..(278): a, c, t, g, unknown or other
  misc_feature (278)..(278): n is a, c, g, or t
tcagtacacgtgatcacgaccggtgctcgatttagtctagcgactttgggtttggggctgggagaggagcccagcactagaggtcggcgtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacctcctgacgctctcctgtgcagcgtctggacttcaccttnagtagtcagtggctatcgcacgtgggtcccgcgaggcctaccgaggccgaaggggctagggacggtggggcggtcaggtttataggtggtagtcgtagtaggtaagttacgataaattacgtagtcggactaaggtacccgttccggtagggaaccgggtccgtaacgttaccgaccgttccgtacgtaggtaacgaaacctaacgtaacccgaaacgaaccgacgtacgtacgtactaccgtagtacctaaagtccgaaccgcgtaccgtaggacgaccgacggacggaccgtacggtacgtaacttagttaacgttacgtaggtacgcggtaacggagacggtactacggctaaccg

SEQ ID NO: 265939 - DNA, 817 bp, Homo sapiens
  misc_feature: GYAE6OF02FQFCQ.34.26.C04.1.454.CMB.1.raw
  modified_base (162)..(162): a, c, t, g, unknown or other
  misc_feature (162)..(162): n is a, c, g, or t
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (595)..(595): a, c, t, g, unknown or other
  misc_feature (595)..(595): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagctgggttttccngttgcttcttttaagnggtgtccagtgtcaggtncagctggtggacgttcggaggggggacgtcggtcggccctaggccgtgggtacctcccgtagacgccttcgttaccgtggtcgaccgtaggtccgttacgtacggttaacttcccgtaacccgtttcgtaacggtttacggtcctaaggttcggggaacctagttcggacccgttaaccggttccgggggtccccgacccggtagggtcccgtacccggaagggacccggaagggggggtcccttagggggacggttggggggtcaccggtaagtttagttagggttacgggtaagtaggtaacgggttacggaaaggttcgtaacgtaaaacttacgaacgttcgaaccgagtacccgtacgggtaggaaaccgggtctacgttaccgaccgttaccncgtaacgtaaccgaacctaaccgtaccggaaacgtaccgtacgtacgtacgttaacgtcgttccgtaagtaccgtaaacgtcgaaccctacggtaccgtaggtaaacgaccggtaccgggacgtaaccggtaccgtaacgttacggttaacggtttaaccgttacggtttacggacggttaacgggtaaacggcggtaacggttaccggacccgtaacccgg

SEQ ID NO: 265940 - DNA, 657 bp, Homo sapiens
  misc_feature: GYAE6OF02GUEPZ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacgtccctgagactctcctgtgcagcgtctggattcaccttcagtagtcagtggcagtgcacgttggggtcccgccgaggcctaccgagggccgaagggggctggggagtgggggtgcaggttatagtggtatggatggaaagtagtacaattacgtatgaccgtaagtacctccggtagggaacgggtaccgtactttacccgaacccggttcctacccgaagacggtaaacctaaacgtaaccccaaagaaaccgtaccgactacgtaactacctacggaactaaagtacgaaacccacggtcccgtaaggaacggaacgacccggaacgggaacccgtaccgggtacgtaagttacggttaaactttacggtaggtacggtacggaagtaaccggaggtaaccgaccgaccgtaaccgg

SEQ ID NO: 265941 - DNA, 704 bp, Homo sapiens
  misc_feature: GYAE6OF02F6XRM.34.26.C04.1.454.CMB.1.raw
  modified_base (289)..(289): a, c, t, g, unknown or other
  misc_feature (289)..(289): n is a, c, g, or t
  modified_base (403)..(403): a, c, t, g, unknown or other
  misc_feature (403)..(403): n is a, c, g, or t
tcagtacacgtgatcacgaccggtgctcgatttagtctagcgactttgggtttggggctgggagaggagccctagtcactagaggttcggcggtgtttccgattcggtgatcagcactgaacacagaggactcaccagtggagtttgggctgagcttgggtttcctcgttgctctttaagaggtcgtccagtgtcaggtgcgtagtcgtggtggtagtcggtgggggagcggtcggcccgagccgtgggacgtccctggacggtactctccgtggtcgcgagcgttcgnggtacttccgacttcagtacgtcaagtcggacagtcgactcggtcggcctccgaggtctaccgaaggtccgaagggtctagggcgtggggtcgtcgtaattacgtgtcgggtanacggtagtacggtaagtacgtactaagtacgtagtcgacgtaacgtccgtcgtaagggtaacggtaccgtagttacccgtacgtacgaacccgtagtacgaacgtaacgttaaacccgaaagttacccgaacggttcgttaacgtacgttacgtaagaaccttaacgaacccgtacgaaccgggttaccaccgggtaaagacggaacccgtaagggaccgtacgtacgttaacggtctttaaagtccgttaggtacgaacggttaacggaagtaaccgaacgggtaccctaccggtaacgg

SEQ ID NO: 265942 - DNA, 704 bp, Homo sapiens
  misc_feature: GYAE6OF02I1X6L.34.26.C04.1.454.CMB.1.raw
  modified_base (196)..(196): a, c, t, g, unknown or other
  misc_feature (196)..(196): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggcccagccgtgggactcctgacgctcnctgngcagctcgtggacttccacctttacagttacgtcagttcggacacttcgaccaccggttcggggtccccgaccgagggtccctaccgaacggggtacgaaacgggggtccgtaggggtacgggtagggggtcggaccgttaaaggtttataacggttgggttaataggtaaggttaagggaaagtttactacgtaaagttaaccgtaagtcgactaacggttaccgtacggtacggtaacgggtccctaagttacccgaccgttacgtaccgaaggaccgaaacctaacgtaacccgaaagtaaccgtacgtacgttactaacgtcctagaactaagtacgaaccacgtcgtacggaacggtacgaccggaacgggtaccacggtacgttaagtacggtttagtacgtaggtacggtacgacgtaacggacaaccgaccgtacctaacgg

SEQ ID NO: 265943 - DNA, 717 bp, Homo sapiens
  misc_feature: GYAE6OF02JIZT6.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagccgtgggacgtccctgacgactctccgtgtgcagcgtgtggtacttcaccttcgagtactcagtggcagtcgcgacgtcggccgccgaggtcctccgaggccgaaggggtcctagggtaggtggggtcgacgtaaggtttataacggtgggttaatcgggtagttacgggtaaagttaggttacctaaaagttaccgttaggtcgtacgaacgggtacccgttacccgggtaaagggtaaaccggggtacccgttaaccgttttaacccggtaccccgggtttaccgtacccggaaacggtaaaccgaaacccgttaaacccgtaaccccgaaaaccggtaaacccgttaccgtacgtttaagtacccttcgtaaccgtaccgttaaaacgtccgaaccgtcgtacctaggaacgaccggtacgacggacgacggtcgttaagtagttacgtacgtgacgaggacgacgacgacgtacgacctacgg

SEQ ID NO: 265944 - DNA, 658 bp, Homo sapiens
  misc_feature: GYAE6OF02I5D7J.34.26.C04.1.454.CMB.1.raw
  modified_base (148)..(148): a, c, t, g, unknown or other
  misc_feature (148)..(148): n is a, c, g, or t
  modified_base (158)..(158): a, c, t, g, unknown or other
  misc_feature (158)..(158): n is a, c, g, or t
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (187)..(187): a, c, t, g, unknown or other
  misc_feature (187)..(187): n is a, c, g, or t
  modified_base (249)..(249): a, c, t, g, unknown or other
  misc_feature (249)..(249): n is a, c, g, or t
  modified_base (279)..(279): a, c, t, g, unknown or other
  misc_feature (279)..(279): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctganctggtttccngtnctctttaagngtgtcagtgtcaggtncagctggtggagtcgtgggggagcgtcggcccagcctgggaccgtccctgacgctcctctgngcagtcgtctggattcaccttcaagttacncagtcggctatggcctacggtcggtccccgctagggcctccggaagggtcgaaagggggtctaggggacggttggggtcggtactaggtttataggtggttaaactggaagttagggtattacggtaacaagttactaggttcgacgactcggtaccgtacggaacggtcgtaacttaccgaccgtctaccgaagtacgaaacctacttaaccgaagtaacgtctacgttagacgtacgtataacgtaactacgaacccgtacgtaccgtagggaaaccgtacggaccggtaaggtccgaaccggtatttaaccggttagttaccggttagttacggtacggacggacgggaacgtacggactacccggtactaaccgg

SEQ ID NO: 265945 - DNA, 871 bp, Homo sapiens
  misc_feature: GYAE6OF02JWP48.34.26.C04.1.454.CMB.1.raw
  modified_base (169)..(169): a, c, t, g, unknown or other
  misc_feature (169)..(169): n is a, c, g, or t
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (511)..(511): a, c, t, g, unknown or other
  misc_feature (511)..(511): n is a, c, g, or t
tcagtacacgtgatcacgaccggtgctcgatttagtctagcgactttgggtttgggctgggagaggagcccagcactagaggtcggcgtgtttccattcggtgatcagcactgaacacagagactcgaccagtcggagtttgggacttggacgtcgttgggtttttccncggttagcttcttttaaagnggttgtccagtcgtcaggtcncagcgtggtgagtcgtagggggagcgtcggccctagcccgttggggacccttccgtaggaacgtaccttccgttccggtgttcgaccgtaggtccgtcgttggtacctttcctaccgttgacgtttaacgctagttcggactacgtgacgtacgggtcgggcccacgtacggcttaccgagggacgtaacggggctaggggtacggtttcggggcgtaccggtaggtttaacttacgggtaggttacggtgggtaagtttacgggaaggttaaccgttacgggaaaaactttaccggggtntaccggggtaaaccgtaccgggttaacccgtccgggtaacgggtaccggtaccgttaacctttaccggacccgtttccgtaaccggaaaggtacctaaaacccgtaccggtaaacccgaaaagggtaccctacccggttaaaggttccgtaaaacgttccgttaaacgaaccggttaaacgtaccggtaaccgttacccgggttaaccgtaggtaaaccccggtaaccgaaccgggttaacccggacggttaaccgtttaacccgaaggttttccggtttaaaaccggttcccggtaaggtttaccggaaccggtttaaacggccggtaaaccgttccgtaacgttacccccggtaacgg

SEQ ID NO: 265946 - DNA, 745 bp, Homo sapiens
  misc_feature: GYAE6OF02GRQ2X.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcgaggtgcagcgtggtggagtcgtgggggaggtcgtcggcccaggccgtgggaccgtccctggagacctctccgtgtcgcgagtccgtcgtggtacttctaccttcgagtactcaagtcggcagtcggacctacggttcgggtcccgaccgacggtcctaccgaagggaccggtaaggggtcgtacgggtgggtggggtcggacgtaggtttaacgtagtcggtaagtacggtaaggtacggtaaaaggttacgtaacgtaaagttacctagtacgaaccgtacggtacccgtaccgggtacgggaaacgggtcccttaagttaccccgtaaccgttccgtaaccgtacggtaaaccaaccgtaaaccgtaaccccgaaaaggaacccgtaccgttacgttaacgtactaccggtataaacccgtaaagtcccgaaccgtaccgtacggttaacggacgaacggaaccgggaggacccgtacgtacgtaaggtttaactaacgtttaccggtggacggttaacgacggtaacggaacgactaccggaccgtaacgg

SEQ ID NO: 265947 - DNA, 574 bp, Homo sapiens
  misc_feature: GYAE6OF02GHR4F.34.26.C04.1.454.CMB.1.raw
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggaggcgtggccccaggccgtgggaccgtccctggacgacctctcctgtgcagcgtctggntcacttnagtntcatggcagtgcacgtgggtccnccgaggctccgagggcgaggggctagggagtcggggtgctaaggttatagtaggtatgaagtcggaagtntacaatctagtcgacacgacgtccgaggtaagggcctacgttccaccgtctaccgaagacgtaacacctaccgaagaccacgactagtatctagaaccgtaatcgaaccacgtctagacgagaccgacggaccacggtacctgtacggttaacttgttcgagaggtaacggaagaccgtacgacgtccgtaacg

SEQ ID NO: 265948 - DNA, 824 bp, Homo sapiens
  misc_feature: GYAE6OF02I284I.34.26.C04.1.454.CMB.1.raw
tcagtacacgtgatcacgaccggtgctcgatttagtctagcgacttttgggtttgggggctgggagaggagcccagcactagaggtcggcggtgtttccattcggtgatcagcactgaacacagaggactcaccatggagtttgggctgagcttgggttttcctcggttgcttcttttaagaggtgtccagtgtcgaggtgcagtctgggtggagtcgtgggggagagtcggaccagccgtgggacctccgtagacgactctacctgtcgcaggcgtcgtaggtacttactaccctttacgagttacgtactaagtgggacctagtcggtacccgtaccggttccggggtaccccgtcccgagggtcccctacccgtaagggggacccgggaaaggggggtacccgttgggggaacgggtttcgggggggtacggtaccgttaaagggttttacgttaaaggttaggggttttaacaggttaacgggttaaggggtaaacgtttaacgggttaacaaacggtttaactaaggtacgtccgtaacgtaccgttaccgggtaaacgggaacggtccccggtaaagttccccggtaacccttccgtaccgaacgaaccgtaaccgtaaaccgtaacccgaaagtaacccgtaccggttattaaccggacttacggtaacgtaaacgaaccgttacgacccggtaagcccggtaagacggacggtaacccggaggaccgtaacgggtcttaacgggttacgttcgttacgtcgtaaccgggtaacgacggttaaacggaaccgtaaccgtacccgaccgttaaaccgg

SEQ ID NO: 265949 - DNA, 623 bp, Homo sapiens
  misc_feature: GYAE6OF02IZFZA.34.26.C04.1.454.CMB.1.raw
  modified_base (178)..(178): a, c, t, g, unknown or other
  misc_feature (178)..(178): n is a, c, g, or t
  modified_base (270)..(270): a, c, t, g, unknown or other
  misc_feature (270)..(270): n is a, c, g, or t
  modified_base (329)..(329): a, c, t, g, unknown or other
  misc_feature (329)..(329): n is a, c, g, or t
  modified_base (447)..(447): a, c, t, g, unknown or other
  misc_feature (447)..(447): n is a, c, g, or t
  modified_base (556)..(556): a, c, t, g, unknown or other
  misc_feature (556)..(556): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtgcagtcgtgggtggagtcggtggggggagcggtggcccaggccgtggggacctccctggacgcctctccgttggngaccaggcgtactggacttccaccttcagtagtcagtggcatgctacggtcgggtcccncaggcctccgagggccgaaggggctgggaggtggggagtacgtagttataggtggtatggtagtacgggtaagtgtactaagttactagtgacagtaccgtcggtaggacggaccgtntaccgcctcgacaggacgtactaacgtacccgaaagtacgccgtacttagtcctacgtcgaacctaagtaccactaccgtcgtaacggacggtaaccgacgtacggacnccggttatacgttacgttactacggtacgtacgggacgacggtaacgacggaacctcgacccgtacg

SEQ ID NO: 265950 - DNA, 704 bp, Homo sapiens
  misc_feature: GYAE6OF02JV7ZQ.34.26.C04.1.454.CMB.1.raw
  modified_base (582)..(582): a, c, t, g, unknown or other
  misc_feature (582)..(582): n is a, c, g, or t
  modified_base (670)..(670): a, c, t, g, unknown or other
  misc_feature (670)..(670): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgacgctgggtttttcctcgttgcttcttttaagaggtgtccagttgtcaggtgcaggctggtggaagtcgtgggggagcgtggccctaggccgttggggaccgtccctggacgtacctccgttcctggtacgccgtacgtcggttcgtacggtacttccaaccttttcgaacgttaacgttcacgtttgggacctagtcgtaccgaccggttccggggtcccgaccccgaaggtccggtaccgaagggtccggaaaggggggtccttaggggcggttggggggtacggtaccttaaggtttacttaagttggggtaacctagggtacgtagggtaaacgtacgttacgtaaaactcttaggacgacgtcgtaaccgtcggacgtacggcgtacgtcgtacgtacacgagtacgaccaactaccgaacacgtaccgnttacgtacgtcgagtaacgacgtacgaccgtacgtccgtagtacgacggtaccgacgacgtaccggtagtaaggttactcgttaacgngtacgacgtacgtacgagtaccgctaccgtacgg

SEQ ID NO: 265951 - DNA, 539 bp, Homo sapiens
  misc_feature: GYAE6OF02FN7BA.34.26.C04.1.454.CMB.1.raw
  modified_base (458)..(458): a, c, t, g, unknown or other
  misc_feature (458)..(458): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtgggtccgccgaggcctccgaggcaaaggggctgggagtggggtgctagttatatgggtatgagtggaagtgtacaaatactatgacacgacgtccggtaggaacgggccgattaccgaccgttctccgaagacgacaactcccaaagaaccacgtctagtacnctgacaatcgaaccgagacctgacgagaccgaggacgacgacgtaatgttactacgtgtgacgagagagactagcctaacg

SEQ ID NO: 265952 - DNA, 717 bp, Homo sapiens
  misc_feature: GYAE6OF02I7VOA.34.26.C04.1.454.CMB.1.raw
  modified_base (196)..(196): a, c, t, g, unknown or other
  misc_feature (196)..(196): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtncagctggtggagtcgtgggggagcgtggcccaggcccgtggggacctcccgtgacgaccttctcctggtagcagccgtctggacttcaccttcagtacgtcatggcattcgcctacgtgggtcccgccgaggcctccgaagggcgaaagggggtcctaggggaggttggggtcggactaaggtttatacgttgggtaattggaacgttagggaaacgttacgtactaaagttacttagtcgacgacgtaccttcgggtaggaaacgggtcccgtaacgttacccgtaacccggtccttaccgaaggtaacgtaaaccctaaccgttaaccccgaaagtaaacccgtaacgtccgttaacggttacttaccgtagtaaccgtaaactaccggaaccctacgtaccgtaacggaaggaaccggaccggtaaggaccgtaacgggtaccgttaagttaacggttaacgttaccgtaggttacggaacggtaacggaacgtaaccgaacgtaccgccttaaccgg

SEQ ID NO: 265953 - DNA, 736 bp, Homo sapiens
  misc_feature: GYAE6OF02JODXB.34.26.C04.1.454.CMB.1.raw
  modified_base (188)..(188): a, c, t, g, unknown or other
  misc_feature (188)..(188): n is a, c, g, or t
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (639)..(639): a, c, t, g, unknown or other
  misc_feature (639)..(639): n is a, c, g, or t
  modified_base (694)..(694): a, c, t, g, unknown or other
  misc_feature (694)..(694): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcgttgcttacttttaagaggtgtccngtgtcaggtncagctggtgagtcgtgggggngtcgtcggcccagccgtgggaccgtccctgacgacttcgtccgtaggtgcaggtcgtctaggacttcctacttcgagttacgtcagttcggctagtcggacgtcgttcggggtccccgaccgagggtccttaccggacgggtacgtaaacgggggtccgttaggggaaggttccgggggtaggaccgtttaaggtttaacgtaggttaacgggttctacgggtaaagtcgggtaaagtacgtaacgtaacttaacgtgtaccgcgttaagtacccgtcggttaacgggacgggaccgttactaccgtaccggttactacgggaagtaaccgaccgtaaccgtaaccgaaacgtaaccgtccggactttaacgtactacttaacgggaacctaaacgtccgtaaccgtacgtacccggtanaacggtaacgcccgtaaccgggacgtacgtacgttaagttaccgttagttaaccngggttaagacgaacggtacgtaaccggcttaccgcgtaaccg

SEQ ID NO: 265954 - DNA, 731 bp, Homo sapiens
  misc_feature: GYAE6OF02FZ54H.34.26.C04.1.454.CMB.1.raw
tcagtacacgtgatcacgaccggtgctcgatttagtctagcgactttgggtttgggggctgggagaggagcccagcactagaggtcggcggtgtttccattcggtgatcagcactgaacacagaggactcaccatggagttgggctgagcgtggtttcctcgtgctctttaagaggtgtccagtgtcgtaggtgcagcgtggtgggaggtcggtgggggagggcggtcggccccgacgccgtcgggaccgtcccgtgagtcctaaaaaaaaacctcctgtgcgacgcgtcgtggtacttctaccttactagtacgtacagtggcagtcgcaccgtacgggtccgtaaccgacggtccgtaccgacggaccggaacgggtcgtacgggtagggtgggggtacggtacgtaaggttagtaacgttaggtaagtaggtaagtaggtaaggtaacgtaactaaacgttaacgtaacgtacgacgaacgtacgttacgaacggtaaccgggactaccgtaccgtacccgcgttacccgaagtacgtaaacctaaccgtaaccgaaacgtaaccgaccgtcgtacgtaacctcggttaacgaacttaaaccgacgtaaccgtaacgccgtaaaggaacggaccggaaccggacggaccgtaacgtacgttaacgttaaggttacgtaaccgttggtacgacggtaacggaagacggaaccacggtaccctaaccggg

SEQ ID NO: 265955 - DNA, 672 bp, Homo sapiens
  misc_feature: GYAE6OF02G0GQC.34.26.C04.1.454.CMB.1.raw
  modified_base (179)..(179): a, c, t, g, unknown or other
  misc_feature (179)..(179): n is a, c, g, or t
  modified_base (316)..(316): a, c, t, g, unknown or other
  misc_feature (316)..(316): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagctggtggagtcgtgggggagcgtggcccaggccgtgggacctccctgagacctcctccgtgtgcagcgtcgtggtacttccaccttcagtagtcatggcatgcacgtcgggtcccnccgtaggcctccgaggcggaaggggcgtgggaggtggggtgactaggttagtagtggtatgagttaggaagtagtacaaatacttagtaggtacaacggtaccgtacggtacggaacgggaccggtacgttaccgtacccgtaccgtaccgaacgaacgaaccgaaccgtaacccgaaacgaaccgaaccgtacgtacgtactacgtacgtaacgtaacgtacgaccgacgtaccgtacggaacggaacggaccggaacggaccgaccggtacgttaacgttacgttaacgttaacgttaggtaccccccccccggtaggtacggaacggaacggaacgaccgtaccgtaacccgg

SEQ ID NO: 265956 - DNA, 793 bp, Homo sapiens
  misc_feature: GYAE6OF02IAF7G.34.26.C04.1.454.CMB.1.raw
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatgggagttgggctgagtctgggttttcctcgttgcttacttttaaaggaggttgtccagtgtcgaggtgcagcgtgggtggaggtcgtggggggcgcgtcggcccaggtcccgtagggaccgtcctagacgaccttccgtccgtggtacncacggtccgttacgtggaactttccaccgtttcgaagttacgtcgagttggactaagttcggccgtacggttacggggtaccccaccggcggtcctaccggaagggaccggtaaacgggggcttagggggagggttcgggggacggtacgttaaggtttaacgtaggtttaagggggtaactaggtaacggtaagggtaaacggtaacggttactaaaatttaacgtagttaccggacggtaaccgtacccggttaccgggtaaggggtaacccgggtaccggtaaccgttacccgtaaccggtaccgttacccgaaacgtaacgaaaccctaaaccgtaacccgaaacggaacctaccggtagttaccgacgtccgtaacgtaacaaacgtaccgaacgaacgacgtacggaacgaccggaacggacgaacgaaccggtaccgtggttaacgttaacgtccggttgacggtacggacggaaacggacggaacgtacccgcgtaacccgg

SEQ ID NO: 265957 - DNA, 658 bp, Homo sapiens
  misc_feature: GYAE6OF02HH7JI.34.26.C04.1.454.CMB.1.raw
tcagtacacgtgatcacgaccggtgctcgatttagtctagcgactttggggtttggggctgggagaggagcccagcactagaggtcggcggtgtttccattcggtgatcagcactgaacacagaggactcaccagtggagtttgggctgagtcttggggttttcctcgtttgcttcttttaagaggtgtccagtgtcaggtgcagctgggtggagtcgtgggggagcgtgggcccagcctgggactccctgacgctctcctgtgcagcgtctggtacttcaccttcagtagtcagtggcatgacacgttcgggtcccgaccgaggtcctaccgagggccgaagggggcttagggaggttcggggtggactaggtttacagtagggtataggtatagggaacgttagtaccaaattccgtaagtcggacagtaccgtccgtaggaacgggtacctaagtcccgaccgttactaccgagtaacgaacctaacgtaacccgtaagaacctaccgtactacggtaactccgtacgaacgtaaacgtcgaaccgacgccgttaaggaacgtacgtaccggacgggactaccggtattaagttacgttacgttaaccgtgtaggtaccggtaagggaggtaaccgaacgacggtaccctaacgg

SEQ ID NO: 265958 - DNA, 823 bp, Homo sapiens
  misc_feature: GYAE6OF02IDF0H.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcgtgggttttcctcgttgcttcttttaagnggtgtccagtgtcaggtgcagctggtggagtcgtgggggagcgtcggcccaggcccgtggggacctcccgtgacgaccttcgtcctggtcgcgtaggtccgttcgtaggtacttccgtaacccttttcgaaggttacgttaccaagttcgggacctaagtcgaccgtaccggttcggggtccccaccgtaggcccttaccggaagggaccggtaaagggggtcctagggggtaacggttggggggtacggtaccgttaaggttttaacgtaggttaggggttaaactgggtaagttaacggggtaaaacgttacggtacctaaaagttaaccttagtacggacccgtaacgtaccggtacgggtaacgggtaaacccgggtaccgttaacgttcccgtaacccgttccgtacccgtaaggaaccgtaacctaaaccgttaacccgaaaacgtaaccgaccgttaccgtagttaccttacgtaacgtaaacgtaacgtaccggaacctacggtaccgtaggaaccgaccgggtaaccgaacggtaaccggtaaccggtagttaccggtttaacgttaacgttaccggttacgtacgggtaaccgtaacggaacggtaaccgtaaccggtaccgtacccgtaacggg

SEQ ID NO: 265959 - DNA, 724 bp, Homo sapiens
  misc_feature: GYAE6OF02JCRAJ.34.26.C04.1.454.CMB.1.raw
  modified_base (248)..(248): a, c, t, g, unknown or other
  misc_feature (248)..(248): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggacctccctggacnctcctcgtgcgcgacgtcgttcggtagtacttacctaccgttacgtaaggttacgtcctaggtcggactacgtcggacctacgggttccgggtcccgaccggacgggtccctacggaacgggtaccgggtaaacgggggtcgtacggggtaggggttcgggggtacggtacgttaaggtttagttagggttaggttaagtggtaaggtaggggtaaagttacgtaactaacttagtacgtacgacgttaacgtaccggttaccgggtaagggtaaccgggacttaacgttcccgaacccgttcgtaccgaaacggtacaacccgtaacctaaccgaacgtaaaccgcggtacttacgtaccttcgaacgaaccctaagccgtaacctacgaccgtaggaaccgacgacggaccggtcgaacggtctaagttaccgtagttacgtgagtacggaagtacgacgacgccaccgtacgg

SEQ ID NO: 265960 - DNA, 796 bp, Homo sapiens
  misc_feature: GYAE6OF02IEM9D.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcgaggtgcagctgggtggagtcgtggggggaggcggtcgggcccaggcccgtggggaccgttcccgtaggacgtaccttccgtcccgtggtcgcaggtcgtcgtggtacttcgaccttcaggtacgtacagttggctagtgaccacggtcgggtcccgcgacggtcctaccggagggacggaaggggtctggggaggtggggtacggactaggtttatagttgggtataggtagtaggtaaagtagtactaaattacgtagcgtacgaacgtaccgttaccgggtagggaaccgggtccgttaacgttacccggtacccggtttcccgtaaccggtaacggaaaccgtaaaccgtaaacccttaaccccggaaaaaggaacccgtaaccggacgtttacggtaaccgtttacggtaaccgtaaacgtaaaaccgttacccgaaaccgttaaccggtacccgtaaggggaacgaacccgggtaccgggaaccggtaccggtaccgggttaccgttaaacggtttacggtttaaccgttaaccggtttagggacggtaaccgggttaacgggaacggtaacgggaaccgacccggtaccctaaccgggg

SEQ ID NO: 265961 - DNA, 741 bp, Homo sapiens
  misc_feature: GYAE6OF02HY8TF.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttttcctcgttgcttcgttttaagaggtgtccagtgtcaggtgcagctggtggagtcgtgggggagcgtcggccagccgtgggactcctgacgactctcgtgtgcagcgtctggacttccaccttcgagttagtcagtggctatcgctacgttcgggaccaccgacggtcctccgagggaccgaaggggtccgtagggtaggtggggtcggacttaaggtttaactaggttaggtaattggaaggtaggtaaaagttacggtaactaaaacttacgtaagttcggacgtaacggtacccgttaccgggtacgggtaacggggtacccgttaaccgttaccggtacccgttccgtaaccggaacggtaacgaaaccgttaaacccgttaaccccgaaaaggtaaacccgtaccggtaccgttagttaaccgttacgtaacgtaaacgtaaacgtccgaaaccgtaaccgtccgtaacggaaacggaccggacggacggaacccgacggttaccgttaaggttacgttaacgttacggttaggtacggaccggaaggaggaaccggtaacgtacggaccctaaccggg

SEQ ID NO: 265962 - DNA, 751 bp, Homo sapiens
  misc_feature: GYAE6OF02HHFDU.34.26.C04.1.454.CMB.1.raw
  modified_base (162)..(162): a, c, t, g, unknown or other
  misc_feature (162)..(162): n is a, c, g, or t
  modified_base (203)..(203): a, c, t, g, unknown or other
  misc_feature (203)..(203): n is a, c, g, or t
  modified_base (317)..(317): a, c, t, g, unknown or other
  misc_feature (317)..(317): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgtggttttccncgttgcttacttttaagaggtcgtccgagtgtcgaggtgcngcgtgggtggaggtcgtgggggaggcgtggcccaggccgtgggaccgtcctggacgactctccgtagtcgctacgccgtgtaggtacttctaccttcgagtactcagtggactntcgaccgtcgtcgggccgcgtacggcctaccggagggaccggaacggggtcgtagggtacgggtcgggggtcggactacgggtttaagcgggttaggtaagtaggtacgttacggggtaaaaagtttcggtaaactaaacgttaacgtaggtacgtaccggtaacgtaccggggttttacggacgggtaaaccggggtccctttaacggtaaccccgtacccggttctacccgtaaagacggtaacccgtaaacttaccccggaaagcccgtaaacggtcttacgacgtacccgtagaacaaggtaccaaccggcgttaacgaaccggtggaaacccggtacgaacggtacccgtaagggtaccttaacgttaccgtaagttaccgtggtaaaggccgtaaaggaacgttaccggaatcccggtaacctacggg

SEQ ID NO: 265963 - DNA, 852 bp, Homo sapiens
  misc_feature: GYAE6OF02FW0PQ.34.26.C04.1.454.CMB.1.raw
  modified_base (179)..(179): a, c, t, g, unknown or other
  misc_feature (179)..(179): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggtgtccagtgtcagggtgcagtctggtggagtcggtaggggggaggtcggtcggccccgaaggtcccgtggggaccgttccccgtaggacgtacctcctccgtggtgctaggtcctcgtggtacttcctacccgtttcgaagttacgtctagttcgggtactagtcggtacctaccgggttacggggtccccgaccgacgggtcctaccgggaacgggtaccgggaagggggtccgtagggggtacgggttcggggtacgtaccggtaaagtttacgtaaggttaggtaacttaggtaacggttaggtaaaggttaacggtaacttaaagtaaccgttaagtacggtaacctaacggtaccgtttacccgggtaagggtaacccgggtccgttaaccgttacccgtaccccgttacctaaccggtaacggtaacgaaaccctaacgtaaccccgaaacgtaaaccgtaccgtacgttacgtaccgttaccgttaaacgaccgttaaacgtaccgtaacccgtaccgtaaccggtaggtaacccgtaacgggaacccgggtaacgggtacccgtaacgggttaacgttacggttaaccgttttaacgttaccggtaacggttacggacgtaaacgggtaacgtaaccggaccggtaacctacccggtaaccgg

SEQ ID NO: 265964 - DNA, 689 bp, Homo sapiens
  misc_feature: GYAE6OF02JIDMO.34.26.C04.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgtgctcttttaagaggtntcagtgtcaggtncagctggtggatcgtgggggagcgtggcccagccgtggggacctcccgaggagtacctcctccgtgtgctaggccgtcttgggacttccgacctttacaggttagtccagtgggcctagttgcctaacgtcgggttccgaccagggcctaccggagggccgaagggggtctagggaggttggggcggacctaggttataaggtggttaagtcggtaagtgggtaaaacgttgtaacgtaatacctagtcggtacgaacgtaccgttccggtaaggaacgggtacccgtaattcccgaccgtacctaccgtaaggaccgaactaaccggtaccaaacggtaaacccacggtcgttacgtacttcgaacgtacttaaacggtccgaccgacgtaaccggtagtaaacgtaccgggaccggtaacgggaccgtaacgggattacggtagttaacgtcgttcggtaacggacggtagaggtacgacgtacgcccgtaacgg

SEQ ID NO: 265965 - DNA, 745 bp, Homo sapiens
  misc_feature: GYAE6OF02IT7US.34.26.C04.1.454.CMB.1.raw
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggacgcgtggccagcctagggactcccngacgacctctcctgtgcgagcgtntggtacttccaccttcagttacgcagtgcatgactacgtcgggtccncgacggctccgaggtcgaagggctagggaggtcgggtaggactaggttataggtggttanacggtagttagggaacgttacgtaaccttaagtacgtatacggctaacggtaccgtaccggtaaggaaccgggtacccgtaacgtttacccggtacccgttaccgtaccgaacggtaacgaaccctaaccgtaaacccgaaacggtaaccccgtaacgttaccgttacggtaaccttcccggtaactaacgtaaaccgtaccgaacccgtacgggtacccgttaaggtaaaccggtaaccgggacccggtaacgggacccgaacgggtttaaccgttaacggttaaccggttaaccgttaccgttacgggttaccggtaacggaacgggtaaaccggtacccggaaacccgtacggaacccttaacccggg

SEQ ID NO: 265966 - DNA, 666 bp, Homo sapiens
  misc_feature: GYAE6OF02GR93L.34.26.C04.1.454.CMB.1.raw
  modified_base (268)..(268): a, c, t, g, unknown or other
  misc_feature (268)..(268): n is a, c, g, or t
  modified_base (351)..(351): a, c, t, g, unknown or other
  misc_feature (351)..(351): n is a, c, g, or t
  modified_base (444)..(444): a, c, t, g, unknown or other
  misc_feature (444)..(444): n is a, c, g, or t
  modified_base (598)..(598): a, c, t, g, unknown or other
  misc_feature (598)..(598): n is a, c, g, or t
  modified_base (638)..(638): a, c, t, g, unknown or other
  misc_feature (638)..(638): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttgggctgagcttgggttttcctcgttgcttcttttaagaggttctccagttgtcaggtgcagtctggtggagtcgtgggggacgcgtcggcccaggccctgggaccgtccctgagacctctcctgtncgtagccgttcgtaggtactttccgacccttttgaagttcgtccaagttcggctattcggcctacggttccgggggtaccccncccgtaacggggtcctacccggaagggcccggtaaggggggtccttaggggacgggttgggggtcgacgtaggtttaagtagtgggtttaagnggaagtttcgggtaaattacgtacaaacgttctaggtcaacaacggtccgtccggtaaggaacgggtcccgttaattaccgacccgttactacccgaagtacgtaacgaacctacccgaaacgacaccgtctagtatccagtacaactcgaacncgtacctaggacgacgacgagcgacgtgtatacgtatcgngtcgaagacgagacgcgtacgcctacgg

SEQ ID NO: 265967 - DNA, 576 bp, Homo sapiens
  misc_feature: GYAE6OF02HLI5D.34.26.C04.1.454.CMB.1.raw
  modified_base (307)..(307): a, c, t, g, unknown or other
  misc_feature (307)..(307): n is a, c, g, or t
  modified_base (473)..(473): a, c, t, g, unknown or other
  misc_feature (473)..(473): n is a, c, g, or t
  modified_base (516)..(516): a, c, t, g, unknown or other
  misc_feature (516)..(516): n is a, c, g, or t
  modified_base (536)..(536): a, c, t, g, unknown or other
  misc_feature (536)..(536): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgacgactctcctgtgcagcgtctggattcaccttcagtatcagtggcatgcacgtgggtcccnccaggcctccgaggcgaaggggctgggagtggggtgctaggttatagtggtatgagtagggaagttagtacaaattactagtcgacacgtacgtcggtaggaacgggcctattccgaccgttctaccgagaacgacaactacccgaaagaaccacgctatactganaacaatcgaccacgcctaggacgacgccgaggacgaccggttntaaggtcgttaagttaccgnggttacgaggaacggagtaacggacacggtacctaaccgg

SEQ ID NO: 265968 - DNA, 763 bp, Homo sapiens
  misc_feature: GYAE6OF02I9S2W.34.26.C04.1.454.CMB.1.raw
  modified_base (732)..(732): a, c, t, g, unknown or other
  misc_feature (732)..(732): n is a, c, g, or t
tcagtacacgtgatcacgaccggtgctcgatttagtctagcgactttggggtttgggggcgtggggagaggacgcccagcactagaggtcggcggtgtttccattcggtgatcagcactgaacacagaggactcaccagtggagtttgggctgagtcttgggtttcctcgttgacttcgttttaaggcggttgtccaggttcgtcgagggtgacgaggtcgtgggtaggacgggtcggtgggggggaacgtccggtcggacccgaggtccggtaggggtacccgtcccgtaggaccgtaccgttccgtccgtggtcgacgtacggtccgttagtacgggtactttccaacccgtttgacggttagctaggtcggctagttcgccgtacggtcgggtcccgccgaggtcctaccggaggtccgaacggggtctaggggacgtggggtccgtaacgttagttagacggttaggtacggtacgtaggttacgggaaatttacggaactaaacgttctaaggtcggtaccgtagtacccggtcggtaacgggtaccggtaccgtaacgtaccgaccgttccgacgtaaggtaacgtaacctaacgaaccggttacaacggtaccgtacgtcgtaacctacgtacgtaacgtaaagtcggaaacctcggtacgacggacgtaacggacgaccgtacgttacggtaaccttaggaccgttaggtaccgttggaaccgnggttacgacgtggtacctacggccctaaggg

SEQ ID NO: 265969 - DNA, 653 bp, Homo sapiens
  misc_feature: GYAE6OF02G25EP.34.26.C04.1.454.CMB.1.raw
  modified_base (165)..(165): a, c, t, g, unknown or other
  misc_feature (165)..(165): n is a, c, g, or t
  modified_base (176)..(176): a, c, t, g, unknown or other
  misc_feature (176)..(176): n is a, c, g, or t
  modified_base (190)..(190): a, c, t, g, unknown or other
  misc_feature (190)..(190): n is a, c, g, or t
  modified_base (208)..(208): a, c, t, g, unknown or other
  misc_feature (208)..(208): n is a, c, g, or t
  modified_base (277)..(277): a, c, t, g, unknown or other
  misc_feature (277)..(277): n is a, c, g, or t
  modified_base (316)..(316): a, c, t, g, unknown or other
  misc_feature (316)..(316): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (544)..(544): a, c, t, g, unknown or other
  misc_feature (544)..(544): n is a, c, g, or t
  modified_base (627)..(627): a, c, t, g, unknown or other
  misc_feature (627)..(627): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagctgggtttccgttgctntttaagaggtntccagtgtcaggtncagctggtaggacgtcgngggggtacgcgtgcccagccgtgggacctcctgagactctcgtgtgcagtctcgagtacttcgaccttnagttacgcagtaggcctagtcgcctaccggttgggaccnccgaaggcctaccggagggactaagggcgtagggngttacggggagnttacgttaattaggngggtttaancggtaaagtcgggaaaacgttacggtactaaaacgttcgtaacgtcggtacgaacttaccggtccggtaagggtaaccggaccgttaacgtacccgttaccgtacgttaccgaaggtaaccgaaccgtaactacccgtaaacgaactacgacgttanacgtcgttaagaaccgtaagcccgtactaccgtacgaggaacgtacgaaccgacggtacgaacgtacgttaagccgtatacgngtagcgagtacgaatcgacgctacgg

SEQ ID NO: 265970 - DNA, 792 bp, Homo sapiens
  misc_feature: GYAE6OF02IV0JW.34.26.C04.1.454.CMB.1.raw
  modified_base (387)..(387): a, c, t, g, unknown or other
  misc_feature (387)..(387): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggtttttcctcgttgccttcttttaaggaggttgtccagtgtcaggtgcaggtctggtggagttcgtgggggacgcggtcggcccaggtcccgtaggggaccgttcccgtagggaacgtccttccgttccgttggtcgaccgaggtcccgttcgtggtactttcccacccgttttacaaggttacggtctaacgttcgggctagttcgaccgtaaccggttccggggtcccncccgtaagggtccctacccggaagggacccggtaaaggggggcccttggggaggggtttgggggcggacgtttaaggttaagtaggttaggggtattggggaaaccgtttaggtaaaggttacgtaactaaaagttacctaaggttcgaacgaacgttccgtacgggtacgaacgggtaccgttaacgttcccggtaaaccgttccgtaacccgaaaggaacggtaaccaaccgttaacccgaaagtaacccgacgttacgtactacgtacgacgtaaccgtaatcccgaaccgtacgacgtacggaacgacggtaccgacggactaccggtattaccggttaagttacgttaccgtcggtaacggtacgaacggtaacgaacggactaccggttaacgtaccgg

SEQ ID NO: 265971 - DNA, 642 bp, Homo sapiens
  misc_feature: GYAE6OF02HF0KI.34.26.C04.1.454.CMB.1.raw
  modified_base (163)..(163): a, c, t, g, unknown or other
  misc_feature (163)..(163): n is a, c, g, or t
  modified_base (179)..(179): a, c, t, g, unknown or other
  misc_feature (179)..(179): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (315)..(315): a, c, t, g, unknown or other
  misc_feature (315)..(315): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctggagcttgggttttccncgttgctcttttaagnggtgtccagtgtcaggtgcagcgtggtggagtcgtggggggagcgtcggcccaggcccgtgggacctccctgacgactctctgtcgcagcgtctggattcgaccttnagtagtcatggcatgacncgtcgggcccnccaggcctccgagggcgaaggggcctagggaggtgggtggcctagttagtgtggtatggaattgggaaagttgtactaaagtactagttcggactaaggtaccgtaccggtaggaacgggtccgtacgttccgaacccgtactaccgaaggaacgaacgtaacctaccgaaacgaaccaccgtactaggtactcgtacgtaaccgtaaagtaccgaacccgtacgacccgtaggaacggtaaccgaccgggtaacggaccgtacggtaccgtaagttacgttacgttacgtggtacgacggtacggagtacggacacgtcctaacgg

SEQ ID NO: 265972 - DNA, 801 bp, Homo sapiens
  misc_feature: GYAE6OF02G1FYU.34.26.C04.1.454.CMB.1.raw
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggctcaccatggagtttgggctgagcttgggttttcctcgttgcttcttttaagnggtgtccagtgtcaggtgcagctggtggagtcgtgggggagcgtggcccagccgtgggacctccngacgctcgtcctgtcgcaggcgtgtggtacttccaccttcaggttacgctagttcggactagtcgcctacggttcggggtcccgacgtacgggtcctaccggaagggccggaaagggggtcgttagggtacgggttcgggggtacggtacgttaaggttttaacgtaggttgggttaacgttggtaaggtttaaggggtaaacgtttaggtaaacctaaacgtttacgttaacgttcgggaacccgtaaggttacccgttacgggtaaggggtaaacccgggtacccgtttaacgttcccggtaaccccggttccgtaacccggaaggtaaacccgtaaacccggtaaacccgttaacccgaaaacggtacccgtaaccggtccgtttaacgtacctccgtaaggaaccgtaaacgtcccgggaactaccgttaccggtaaggaaccgtaaccggacgggtaacggaaccgtaccggttaacgtttaaggttacggttaacttacggtccgggtaacgtcggaacggtaccgaacggtaccgaccgtaccgtaacggg

SEQ ID NO: 265973 - DNA, 700 bp, Homo sapiens
  misc_feature: GYAE6OF02GB0JB.34.26.C04.1.454.CMB.1.raw
  modified_base (272)..(272): a, c, t, g, unknown or other
  misc_feature (272)..(272): n is a, c, g, or t
  modified_base (319)..(319): a, c, t, g, unknown or other
  misc_feature (319)..(319): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcttgggttttcctcgttgctcttttaagaggtgtccagtgtcaggtgcagcgtggtgagtcgtgggggagcgtggcccaggccgtgggacgtcccgtgacgactctctgtgacagtcgtcgnggacttccacttcgagtgtcagtggctagtcgctacgtcgggtcccnccgacggcctacgacggacggaaagggggcctaggggaggttcgggggtacggtacgttaaggttaacgtaggttagggtacgtggtaagtacgggtaagttacggtacaacgttagtagtgactaagtaccgtccggttaaggaacgggtaccttacgttacccgtccgttaccgtaccgtaacggaacgaacctaacgtaacccgaaacgtaaccgtacgtaccgtagttaacctacgacggtaaactaacgtaccgaaccgtacgtaccgtaggaacgtaccggaacgggaaccgacgtaccggtaaggtacgttacgttaacgtaccggttaggacggtaacgtacggtaaaccgacggaccgtacgaccctaccgg

SEQ ID NO: 265974 - DNA, 744 bp, Homo sapiens
  misc_feature: GYAE6OF02FU9XB.34.26.C04.1.454.CMB.1.raw
tcagtacacgtgatcacgaccggtgctcgatttagtctagcgactttgggtttgggggtcgttgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgagactctcctgtgcagcgtctggattcaccttcagtagtcatggcatgcacgtcgggtccgccgagggctccgagggccgaaagggggctaggggaggttcggggtggcctaaggtttagtagttggggtaatcggaagtagggtaaaagttaggtactaaagttacttagtcggacgtaacggtacccgttaccggtagggtaaacgggggtaccgtacgtttacccgacccggttccgtacccggtaacggtaacgtaacctaaaccgttacccgaaaacgtaaacccgtacggtaccgttaggttaacttaccggtaacgaaccgtaaaacgttccgaacccgtaacggtcccgttaagggacggtaaaccgggacccggaacgggaaccggtaccgggtaccgttaacgttacggtttaaacgttaccggttacggtaacgggtaccggtaacgggtaacgggtaacggaaccgtacggaccccgtaacccgg

SEQ ID NO: 265975 - DNA, 713 bp, Homo sapiens
  misc_feature: GYAE6OF02HDB7C.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtcgtggacttcaccttcagtagtcatggcagtgccacgtgggtcccgcgaggcctccgaggcgaaggggctagggagtggggtgctagttatagtggtagtcgtaagtgggtaaagttacggtacaaagtacttaagtcggacctaagtacccgttccggtaagggtaaccgggggtcccgttaacgttacccgtacccggttacctacccgtaaggaccggtaaacctaaaccgttacccgaaaaccggaaacccgtaaccggtaccgttaacggtacgttaccgttaacggacctaaaacgtccgaaacccgtaacggtccccgtaagggaacgaacgggtacccgggaagggtacccggaccggtaccgtaaggttacggttaacgtttaccggttaggttacgacgggtaacggtacggaaccggtaacccggtaccgacccgtaacgg

SEQ ID NO: 265976 - DNA, 752 bp, Homo sapiens
  misc_feature: GYAE6OF02H2J7Y.34.26.C04.1.454.CMB.1.raw
  modified_base (180)..(180): a, c, t, g, unknown or other
  misc_feature (180)..(180): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagcttgggttttcctcgttgcttcttttaagnggtgtccagtgtcaggtgcagctgggtggagtcgtgggggagcgtcggccagccgtgggacctccctgacgactctcctgtcgcagtcgtctggtactttccacctttcaacgttacgtacagttcggacagtcgccacggttcggggtaccccgtaccggaacggtccctaccgacggggtaccggaaaacggggggtcctagggggaacggttggggggtaccggaccgttaaggttttaagtacgggttgggtttaacgttaagggaagtttaaggggaaaacgtttacggtacctaaaagtttaaccttaagtgaccgtaacgggtaccgttaccgggtagggaaccgggtacccgtaacgttacccgacccgttcaaccgaaggaaccgaaactaaaccctacccgaaaagaaccctacgtactacggtaactccgtaagaactaaacgtacgaacccgtacgacccgttaaggaacgacccgggtacggtaacggacccgtaggtaccgttaaggttacgttaacttacgtaggtacgagtaagggacacggaactccgacctacg

SEQ ID NO: 265977 - DNA, 778 bp, Homo sapiens
  misc_feature: GYAE6OF02IMTWX.34.26.C04.1.454.CMB.1.raw
  modified_base (231)..(231): a, c, t, g, unknown or other
  misc_feature (231)..(231): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctggagtcgttgggttttcctcggttgcttcgttttaaggaggttcgtccagtggtcaggtgacaggcgtgggtggaggttcggngggggggacgtccggtcggacccaggcccggtggggacccctcccgtggacgtaccttccttcccgtagtcgccaggtccgttacgtggtacttcccgtacccgtttgaggttacgtccaagttcgggacctaagtccgacgtaccggttcgggggtaccccgaccgacggtcctacccggagggaccggaacggggttcgtacggggtagggtggggtcgtacgtaggtttacgtaggtcgggtaataggtacggtaacgggtaagtttaacgtactaaacgttacgtacgtcgggaacgtaccggtaaccgtttcggtaacggggaaccggttaccccgttaacggttaccccgacccggtttaccgacggaaaccgacgaaaccttaacccgaacccgaaacgacgtaccggtatacgtacttgtacgaactaaccggagccgtacgaccgtaacgggacgaaccgtacggaacggtccgacgtacgtaggttacgttacttaccggtagtacggcgaaacggtgaaccgtacgccgacgtacg

SEQ ID NO: 265978 - DNA, 708 bp, Homo sapiens
  misc_feature: GYAE6OF02HKSQA.34.26.C04.1.454.CMB.1.raw
  modified_base (177)..(177): a, c, t, g, unknown or other
  misc_feature (177)..(177): n is a, c, g, or t
  modified_base (230)..(230): a, c, t, g, unknown or other
  misc_feature (230)..(230): n is a, c, g, or t
  modified_base (340)..(340): a, c, t, g, unknown or other
  misc_feature (340)..(340): n is a, c, g, or t
  modified_base (661)..(661): a, c, t, g, unknown or other
  misc_feature (661)..(661): n is a, c, g, or t
  modified_base (690)..(690): a, c, t, g, unknown or other
  misc_feature (690)..(690): n is a, c, g, or t
  modified_base (700)..(700): a, c, t, g, unknown or other
  misc_feature (700)..(700): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcgttggtttcctcgtgcttctttaagnggtgtccagtgtcaggtgcagcgtggtggacgtggtgggggagcgtacggccnggtccgtagggacctccgtagacgtaccttctccgtgtacgcgagtccgttacgtggtaactttcgaccgttagagtacgttcagtcgctgtcgactcggttccggaccncggacgccaccggaggtaacggcgggtcgtgggtaggtcggggtcgaacgttagttacttaggtacggtataggtggtaaaccggtaggttacgttaactaatagtacgtccgaacggtaccggttaacgtcgggtaacgtaacccggggtccttaacggttcccgtaacccgggtcttaaaccggggaacctaaccggtaaaaccgaacccgtaaaccggtaaacaaccccgttaggtaacttaccgtcgtaacgttaccgaacaacgtaccacgtcgaccgaaggtaacggaccgagacccgtaggaccttaggtattntaacggtcagggtcaggacggacggtacncgtaacccgngtaaccgg

SEQ ID NO: 265979 - DNA, 726 bp, Homo sapiens
  misc_feature: GYAE6OF02G6CJW.34.26.C04.1.454.CMB.1.raw
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
  modified_base (319)..(319): a, c, t, g, unknown or other
  misc_feature (319)..(319): n is a, c, g, or t
  modified_base (377)..(377): a, c, t, g, unknown or other
  misc_feature (377)..(377): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaaagnggtntccagtgtcaggtncagctggtggagtcgngggggagcgtggcccagcctaggggactcccagagacctctcctgtnacagcgtctggtacttccaccttcagtacgtcacgtgcaatgaccacgtcgggtcccnccgacggcctaccgagggtcgaaggggtctagggagggttggggtgacgtaggtttanacgttaggactggaagttcgggtaaagttacgtactaaagttacgtagtacggtactaacggtaccgtccggtacgggtaacgggtacccgtacgtaccgacccgttccgtaccgtaacgaacgtaacctaaccgtaaccccgaaacggaaaccgtaccgtacctaacgttacgttaccgtacggtaacctaaacgtacccgtaacccgtaacggaccgtacgggtaacgaaccgggaccggtaaccgggaccggtacccgggtaacgttaacgttaccggtttaacgtttacggtaccggttagttaccggaaggacgggaactaaccggtacccgaacgtaacccgg

SEQ ID NO: 265980 - DNA, 787 bp, Homo sapiens
  misc_feature: GYAE6OF02I97E8.34.26.C04.1.454.CMB.1.raw
  modified_base (195)..(195): a, c, t, g, unknown or other
  misc_feature (195)..(195): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggcccagcctgggactccctgacgactcctctgtgcngcgtctggattccacttcagtancagtggcagtcgctacgttcgggtccgacgtcggcctaccgaaggccgaaggggccttaggggagggttcggggtacggccgtaaaggtttcgttaacgtggggttaatcggggtaaagtttcggggtaaaaacggtttagtaaaccgtaaagttacccgttaaggttcggaacctaacgggtaacccgttccgggttaacgggaaaccggggttaccttaaccgttacccgaaccccggtttacctaccggaaacgtaaccggaaacccgtaacccgttaacccggaaacggaaccttaaaccgggtcctttaacgggtaccttacgttaacggaaccgtaaaaccgttaccgaaccgtacgtaacccggtagggtaaacccgacggggtacccgaaggggaccccgttaaggtaccgtttacggttaaccggttacttaacccgggtggttaaccggaaccggtagaaaacgggtaccgaaacccgaccggtcctaaccccggg

SEQ ID NO: 265981 - DNA, 776 bp, Homo sapiens
  misc_feature: GYAE6OF02JO5KE.34.26.C04.1.454.CMB.1.raw
  modified_base (124)..(124): a, c, t, g, unknown or other
  misc_feature (124)..(124): n is a, c, g, or t
  modified_base (168)..(168): a, c, t, g, unknown or other
  misc_feature (168)..(168): n is a, c, g, or t
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (206)..(206): a, c, t, g, unknown or other
  misc_feature (206)..(206): n is a, c, g, or t
  modified_base (213)..(213): a, c, t, g, unknown or other
  misc_feature (213)..(213): n is a, c, g, or t
  modified_base (725)..(725): a, c, t, g, unknown or other
  misc_feature (725)..(725): n is a, c, g, or t
tcagtacacgtgatcacgaccggtgctcgatttagtctagcgactttgggtttggggctgggagaggagccccagcactagaggtcggcggtgtttccattaccggtgatcaagcactgaacanagaggactcaccatggagtttgggctgagtcgttgggttttccncgtttcgtncccgttagttaggngtcgtcgagtgtagngtgacgnggtcggtggtggtcggtcggggcggggcggtccggtccggttagcccgtcgggtacggttccgtccgttcggtacgtaccgttccgttacccgtcgttggcgtacgccggtcgttacggtacgttacctaccgttaccgtacgtaagttcgacgtaggtcgtacgtcggtcccgaccgtacgggtcggttttacccgaaccggtccgtaccggacggtacggaacgggtccgttaggggtacggtaccgggttacggtacgtaggttaacgtacggtaagttcggaaagttaggtaaccgtaagttacgtaacgttacgtacgtaggaccgtaccgtacgtaaccggtaccggacgtacgtaccgtacgtccgtaccgtacgtaaccgaacgtaacccgtaaccgtaaagtacccgtaacgtacgtacgtacgttaccgtacgtaacgtacgaaccgaacgccgtaaccgtaacgacgacccgaaggtaccgaccggtaccgtacgtcgttnaaacgtttacgtagtacgacggagaacgacggtacgtaggtacccgtaacg

SEQ ID NO: 265982 - DNA, 691 bp, Homo sapiens
  misc_feature: GYAE6OF02FUGIX.34.26.C04.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagtacacgtgatcacgaccggtgctcgatttagtctagcgactttgggtttggggctgggagaggagcccagcactagaggtcggcggtgtttccattcagtgatcagcactgaacacagaggactcaccatggagtttgggctgagcttgggttttcctcgttgcttcttttaagnggtgtccagtgtcaggtncagctggtgagtcgtgggggagcgtggcccagccgtgggacctccctgacgacctctccgtgtcgcagcgtctggtacttcacctttnagtagtcagtggcatcgctacggtcgggtcccaccgtggacctccgagggaccggtaaggggtcctagggtacgggttggggcggacgttagtttaagtagttagggtagttaggagttaacgggtaaagtacgtacgaaagttaccgtagttcgacgaacgtccgtaccgggtaagggaacggtccgtaacttacccgtaacccgttcctaaccgtaaggaaccgtaacctaaacgtaaccccgaaacgaacctaccgtacttaggtaaccttacgacgtaactaaacgtaccggaacccacggttccgaacgaacggaccgaccggtaggaacccgacgggttactaagttaaggttaccttaagtaggtcgacggtaacggaacgtacgaccgtagtaacccg

SEQ ID NO: 265983 - DNA, 638 bp, Homo sapiens
  misc_feature: GYAE6OF02G1CEW.34.26.C04.1.454.CMB.1.raw
  modified_base (195)..(195): a, c, t, g, unknown or other
  misc_feature (195)..(195): n is a, c, g, or t
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
  modified_base (601)..(601): a, c, t, g, unknown or other
  misc_feature (601)..(601): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagctgggtggagtcgtgggggagcggtggcccagcctgggacctccctgacgctctctgtgcagcgtctggacttccacctttcagttagtcatggcatcggcctacggtcgggccncgaggtcctcgaggcgaagggtctgggagtggggtcncgtagttagactggtaagtgacgtttaggaacgttggtacaatttacgagtacggactacgtacgtcgggaacgggtaacggaccgtaccttccgacccgttacaccggaagaccggaaacctaacgttaaccccgaaagaacccgtacgtaccgtacgttaccgtactaaggacctaaagtcccgaacgtaccgcggttaaggacaccggccgtaacgaccgtacggtactaagttcgtaagttaaccgnggttacgtaggaggtacgaacgacgtaccgactacgg

SEQ ID NO: 265984 - DNA, 644 bp, Homo sapiens
  misc_feature: GYAE6OF02H9MS5.34.26.C04.1.454.CMB.1.raw
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
  modified_base (384)..(384): a, c, t, g, unknown or other
  misc_feature (384)..(384): n is a, c, g, or t
  modified_base (539)..(539): a, c, t, g, unknown or other
  misc_feature (539)..(539): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctcgttgctcttttaagaggtgtccagtgtcaggtncagctggtggagttcggtgggggagcggtcggaccagcccgtgggacgtccgtgacggtaccttccgtcctggtgacacgcgtctaggacttcgaccttnagttcgctactggctactgactcggtcggtacccgcacggcctcgnggacggaagggcgtgggaggtggtggactagttagtagtcggtntacggagtcggtaaaaggtcctacgtaaatacgtatggtaacacgtaaccgtcggtacggaacgggtccgttaagtccgtacgttaccgaccgaagaccgaaccaacgtaacccgaacgtaaccgagtaccgttgtagttcaacggaactaaacnccgaaacgccgacgtcggaacgtaccggcggacgtaccgacggtcttaacggtacgtacttacgtagttcgaacggtaacgacggtaacgcgtaccgaccgtacg

SEQ ID NO: 265985 - DNA, 642 bp, Homo sapiens
  misc_feature: GYAE6OF02I6LCU.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggactccctgagactctccgtgtgcagcgtctggattcctaccttcaaggttagtcagtcggcatcgctacgtcggggtccccgccagggcctaccgagggacgaagggggcctaggggtacggtgggggtggccgtaaggtttatacgttgggtaactggaacgttagggtaaagttagtaaccgtaaattacgtatcgacgtaacgtaccgttccggtaaggaacgggcctacgttacccaccggttcctaccgtaggaaccgtacaaaccgtacccgaaagaacctaccgacttagtaactccgtagaacctaaagcgacctaacgccgtaggacgacggacgacggaccacgtacgtattaggttactacgtcgtagcgtaggacgaagacgacgtccctaacgg

SEQ ID NO: 265986 - DNA, 622 bp, Homo sapiens
  misc_feature: GYAE6OF02FWAS1.34.26.C04.1.454.CMB.1.raw
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
tcagtacacgtgatcacgaccggtgctcgatttagtctagcgacttttgggtttgggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggcccagcctgggacctccctgagactctcctgtgcagcgtctggattcaccttnaagttacncagtggcagtcgctacgtggggtcccnccgaggcctccgaggcgaaacgggggctaggggagttcgggggtgactaggtttanagttgggtaatggaagtgggaaaagttagtacaaaattactagtcgacctaaggtactaccggtaggaaacgggtccgtagttaccgaccgtctaccgaagaacggactaaacgtacccaaagaacgaccgacttaggtaactcgtaacgacaaatacgaccaacgcctaagacgacgaccgagggaccacggtacgttaagttgtaacttacggtagtacgacgtaggaacgacggtacacggacctacg

SEQ ID NO: 265987 - DNA, 656 bp, Homo sapiens
  misc_feature: GYAE6OF02JZM8L.34.26.C04.1.454.CMB.1.raw
  modified_base (168)..(168): a, c, t, g, unknown or other
  misc_feature (168)..(168): n is a, c, g, or t
  modified_base (199)..(200): a, c, t, g, unknown or other
  misc_feature (199)..(200): n is a, c, g, or t
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (314)..(314): a, c, t, g, unknown or other
  misc_feature (314)..(314): n is a, c, g, or t
  modified_base (454)..(454): a, c, t, g, unknown or other
  misc_feature (454)..(454): n is a, c, g, or t
  modified_base (538)..(538): a, c, t, g, unknown or other
  misc_feature (538)..(538): n is a, c, g, or t
tcagtacacgtgatcacgaccggtgctcgatttagtctagcgactttgggtttggggcgtgggagaggagcccagcactagaggtcggcggtgtttccattcggtgatcagcactgaacacagaggactcaccatggagtttggctgagccgtgggttttcctcgttncttacttttaagaggtgtccagtgtcaggtnngctggtggagtcgngggggagcgtgacccagccgtgggaccgtcctagagacctcncctggtnacagcgtntggtacttacgacctttcgaagtgtcaagtggaccagtcgacnccgtggtcccgacgtacgccttccgaaggccgaaaggggtctaagggcggttgggacgtcgtaacggttagtaggttacggtatagtaggtaggtaagtacgttaccgaaagttaaccgtagtcggaacgacgttaaccncgggttaacgggaacgacccggtaactacgtaacccgtctacggaacgagtaacgaacgttaacccgaacgaacgacgacgtanacgttacaggactaagaccgaactacgatacgggtacacgacgacgggtaccacggtactaagtcttaagtaccgttagtaacggcgaaggacggtaacgagtaaccgcctaacccgg

SEQ ID NO: 265988 - DNA, 724 bp, Homo sapiens
  misc_feature: GYAE6OF02IQ8DC.34.26.C04.1.454.CMB.1.raw
  modified_base (269)..(269): a, c, t, g, unknown or other
  misc_feature (269)..(269): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggcccagccgtgggactccctggacgacctcctcctgtgccagcgtntggtattccacctttcaagttacgtcagtcggcatgcacgttcggggtcccaccgacggcctccgagggtaccgaaggggccttggggaggttcgggggtcggactaggtttaagttagtaggttaagtggtaacgtagggtaaaaggttacgttaactaaagttacctagtcggactaacggtaccgttaccgggtaaggtaacggggcccgttaattacccgaccgttcgtacccgaagtaaccgaaccgtaaaccttaaccccgaaaggtaaacccacggtaccgttacggttaacctcgtaacgaacttaaagtccgaaccgacgtaccgtacgggaacggaccggtaccgggaaccggtaccgaacgggttaccgtaagttaacggttaattaacggttcggttaaggaccgggaaggacggtaacgaacggtaccgtaccccgtaacgg

SEQ ID NO: 265989 - DNA, 778 bp, Homo sapiens
  misc_feature: GYAE6OF02GQS54.34.26.C04.1.454.CMB.1.raw
  modified_base (302)..(302): a, c, t, g, unknown or other
  misc_feature (302)..(302): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctgttgcttcttttaagaggtgtccagtgtcaggtgcagcgtggtggagtcgtgggggaggcggtcggcccaggcccgtggggaccgtcccctaggacgacctcctccgtggtcgacgacgcgttctggtacttccacctttnaaggtatacagttcggactaagtcgacacggttcgggtcccaccgagggccctaccggagggaccggaagggggtccgttagggtacgggtgggggtcgtacgtacgggtttaataggttaggttaataggtaagttacggggtaaagttacggtaactaaattacgttacggtacgtacgtaacggtaccgttaccgggtaaggtaaccgggtacccgtagtttaccccgacccgttctacccggaagaacgtaacccgtaaaccgttaacccgaaacgtaacccgtacggtaccgttaacggttaccgtaaccgtaacggtaacctaaacggtcccgtaaaccgacggttacccgttaaggaccggtaacgacccgggtaacggtaccggtaccgtacgttaagttacggtttaaacgtccgtttaaggaccggaacgggtgtaaaccggacggtaccgtacgtcccgtaacgg

SEQ ID NO: 265990 - DNA, 717 bp, Homo sapiens
  misc_feature: GYAE6OF02I6DSJ.34.26.C04.1.454.CMB.1.raw
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (321)..(321): a, c, t, g, unknown or other
  misc_feature (321)..(321): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgacgcttggggttttcctcgttgcttcgttttaagaggtntccagtgtcaggtgcagctaggtggagtcgtgggggagcgtggcccagccgtgggactccctgagctctcctgngcagcgtctggatttccaccttcaaggttacgcagtggcagtcgactacggtgggtccccncgaacggcctacccggagggccgtaaaggggtcctggggaacggttgggggtacgtanagttttaagngtgggttaaactgaagtagggtaaagttccgtaanaaattacgtatacggctaacggtacgttccggtaaggaaaccgggtcctaagttcccgaccgttcgacccgaggaacctaaacgtaaacccgttacccgaaagtaaacccggtactaccgttacggttaaccttacgacggtaaaaaccttacggtaaccgtaaccaaccgggttccgtaaggaaccgaaccgggtacccgaagggttaccgaaccggttacctaaggtttaacgtaacgtttacgaacggtcggtacggaacgtaggtaaccaaccggtacgtccccgtaag

SEQ ID NO: 265991 - DNA, 712 bp, Homo sapiens
  misc_feature: GYAE6OF02H1WX0.34.26.C04.1.454.CMB.1.raw
  modified_base (176)..(176): a, c, t, g, unknown or other
  misc_feature (176)..(176): n is a, c, g, or t
  modified_base (243)..(243): a, c, t, g, unknown or other
  misc_feature (243)..(243): n is a, c, g, or t
  modified_base (312)..(312): a, c, t, g, unknown or other
  misc_feature (312)..(312): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggttttcctggttgctcttttaagnggtgtccagtgtcaggtgcagctgggtggagtcgtgggggacgcgtggcccagccgtgggacttccngacgctctcctgtcgcgagcgtctaggacttcacttcagtagtcagtggctatgctacgtcgggtaccncaggtcctaccgagggcgaacgggggtctaggggtaggttcgggggtacggacctttaggtttaaacgtcggtttaggggttaacgtagtaaagggtttagggggtaaaacgttaacggttacctaaaaattacggttacgtacgggaaccgttttaacgggccgttaccgggttacgggaacgggtacccggtagttaccgtaccggtaccgtacggacgtaacggaccgtaaaccgtacccgaaacggaacaccgtacgtacgtaacgtcgtacgaacgtaaacgtacgaaccgacgtaccgacggtaagaccgacgaacggacgtaccggtcgtaacgtagtaacgtaaccgttgaccggtacggacgttaacggaacgtacgaccgtaccgtaacg

SEQ ID NO: 265992 - DNA, 657 bp, Homo sapiens
  misc_feature: GYAE6OF02FQWCF.34.26.C04.1.454.CMB.1.raw
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagcctgggacctccctgagactctcctgtgcagcgtctggtattccaccttcagtagtcagtcggcatgctacgtcgggtcccncgaggtcctaccgagggccgaaggggtctgggacggtgggggtacgcgtagttagtacgtgggtatggatagggaaatagtacaagttactagtggactaagccgtcggtaggaacgggtccgtaacttcccgaccgttcctaccgaaggtaccgaacctaaccgttacccgaaagtaacccaccgtacgttacgtaacgtcgtacgtaaaccaacgtacgacccgtaacgtcccgtaagggtaacggaccggaccggaacggtaccgaaccggtacgtaaggttaccgttaacgttcgtacgtacggacggtaggaacggtacgtaacgtaccgtaccgtaacgg

SEQ ID NO: 265993 - DNA, 971 bp, Homo sapiens
  misc_feature: GYAE6OF02FY5UH.34.26.C04.1.454.CMB.1.raw
tcagtacacgtgatcacgaccggtgctcgatttagtctagcgactttgggtttggggctgggagaggagcccagcactagaggtcggcgtgtttccattcggtgatcagcactgaacacagagactcaccatggagtttggctgagctggttttcctcgttgcttcttttaagaggtgtccagtgtcaggtgcagctggtggagtcgtgggggagtcgtacggcccgaggccgtgggtaccgttcccgtaggacgtacctccttccgtggtacgccaggccgttcgtaggtacttccgtacctttccaggttacgtacagttcggactagtcgaccgtacggtccgggtcccgaccgtaggtccctaccggaagggacggtaaggggtcctaggggtaccggggttacggggtcggtaacgttaacggtttaagtagggttacggtaacgttagggtaacgttaacgggtaaaaggttacgttaaacctaagtttaaaccgtagtaacggtaccgtaaacggttacccggtaccgggtaacggggtaacccgggttaaccggtaacgttttacccccggaaacccggttttccgtaaacccggtaaacgggtaaaccgaaacccggttaaaccttaaccccgggtaaaacgaacccgtttaacccggtcggtttaaaccgttaacccgtttaaccgggttaccgtaaaaaaccgttaacccggggtaaacccgtaaacccgggttaaccgggttaacccggttaaccggggttaaaccccgggaaaaccggggttacccggggtaaaaccggttaaccccggggtaaggttaaacccgttttaaaccgggtttacgtttttaaaacccgggtaccggttttaaacccgggtccgggtaaaacgggttaaccgggttaaaaacggacccggttaaacccgggtaaaccccgggttaccgttaaacccggggg

SEQ ID NO: 265994 - DNA, 845 bp, Homo sapiens
  misc_feature: GYAE6OF02J3K3R.34.26.C04.1.454.CMB.1.raw
tcagtacacgtgatcacgaccggtgctcgatttagtctagcgactttgggtttggggctgggagaggagcccagcactagaggtcggcgtgtttccattcggtgactcagcactgaacacagacggacctcaccagtggtagtttgggctggagtcgttcgggttttcctcggtttgtaccttacgttttaaaggtcggtcgtacctaggtcgtaccgtaggtccgcgtacgtcggttgggtcgggtacggtcgggtcggggggacgtccggtacggccccgtacgtccgggtacgggtcctcccgtgacctacttcctccgtggtcgcgtcggtccgttcgacggtacttaccctaccgtttacgaacggtacgtactacggtacggactacgttcgacccggtcgggttcccggacccgtccgcggttccgacggacgggtaaccggttacgggtcggtagggtccgggttggacgtacggttagtacgtggttacggttagaaggttaaccgagggttaacgtacttaaactaaccgttctaaggtcccgaagttccggtaaccggttacggacgggtaccgtccgtaccgttacccggtcgtaacccgtacgtaaacgggtaccctaacgtaacccgtaaccctaacggtaacccgttcgtaccgttacgtaaccgtccggtaaacctaaccgtaaccgacccgttaaaccgtcggtaacccggttacgaaccggttacccgaacgggaccgggttacctacggttacgtccggttactacggtaccgttacgaccggtacggaaccgtacggtacccgaaccgtaccgtaccggtaccgg

SEQ ID NO: 265995 - DNA, 790 bp, Homo sapiens
  misc_feature: GYAE6OF02GNKNF.34.26.C04.1.454.CMB.1.raw
  modified_base (250)..(250): a, c, t, g, unknown or other
  misc_feature (250)..(250): n is a, c, g, or t
  modified_base (265)..(266): a, c, t, g, unknown or other
  misc_feature (265)..(266): n is a, c, g, or t
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggttgtccagtgtcaggtgcagctggtggagtcgtgggggacggcgtggcccaggccgtgggaccgtcccngacgctctcctgtcnngctctggtattcaccttnagtactcagtggacatcgctacgtcgggtcccnccgaggccctccgaaggtaacgaggggtctagggtacggtggggtacgacgttaaggttatacgggtaggtatcggtaagtagggtaaggtacgtactaaattccgttaaaggtcgacgtacgggtaaccgttcccgggttaaaggaaaccccggggtttccgtaaaccgtttccgtaacccggttacccgtaacccgaagggtaaccgtaaacccaaaccgttaaacccgaaaccgaaaccggtccgttacccttaaggttaaccgttacccgtgtaaaacccgtaaaccgtacggtaaacccgaccggtttaccgaaacggtacggaaccgggtacccgtaaaggggacccgttaaaccgggtaacctttaggttaacccgggtttaacgtttaacccggttcgggtaacggtacccgggttaaaaggtaacggaaccgggtaaaccggtacccggtcccgttaacccggg

SEQ ID NO: 265996 - DNA, 714 bp, Homo sapiens
  misc_feature: GYAE6OF02GUIMA.34.26.C04.1.454.CMB.1.raw
  modified_base (329)..(329): a, c, t, g, unknown or other
  misc_feature (329)..(329): n is a, c, g, or t
  modified_base (410)..(410): a, c, t, g, unknown or other
  misc_feature (410)..(410): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggcccagccgtggggaccgtcccctggacgaccttcctcctggtcgcgaggccgtctggattccaccttcagttagtcagtggcattcgctacgtcggggtcccncgaggcctaccgaggccgaaggggctgggtaggtggggtggactaggtttatagtggtatggtaagtgggaaaagttgtanaaacgttactagtggaccaggtaccgttccgggtaggaacggggacccgttattacccgtacccgttcgtaccgaaaggaaccgaaccgaaacctaaccccggaaacgaaacccgtaccgtacgtttaggttaacctccgttaggaaacccttaaacgtaccggaacccgtacgtaccccgttaaggacggaaaccgacccgggaacggaccgtaccgggtactttaacgtaggttttaaactcgggtttacggacggtaacggaacggaaggtaaccggaaccgtcgggtaacccctaacggg

SEQ ID NO: 265997 - DNA, 660 bp, Homo sapiens
  misc_feature: GYAE6OF02JB4GP.34.26.C04.1.454.CMB.1.raw
  modified_base (176)..(176): a, c, t, g, unknown or other
  misc_feature (176)..(176): n is a, c, g, or t
  modified_base (262)..(262): a, c, t, g, unknown or other
  misc_feature (262)..(262): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcggtgttcgctaggctcttaagaggtntcagtgtcagtgcagctggtggagtcgtggggaagctggcccagcctggggaacgtccctggaacacctctccgttaggcgaaccncgtcgtagtaggtacttaccgaccttacgaaggttacgtcgaagtcgtactagtagacgtacgtcggaccacgtaggtcctacgaggtagacgggtctaggtaggtcggtgtacttagtatagtcggtagaggtaccgtaagggtaacgttactataaagttcgtatacgtacgtaacgtccgttacggtacggaacggtacctacgtttaccgacgttaacgaccgtaaacgaacgtaaccctaactaaaccggtaacgtaacgtacgttacgtttaacgaccgttacgtacggtaaacgttaaagccgtaaaccgcggtacgtagaaccgcggaccgtaagacgtaggtagttacgtagttactcgtagacgtacgagagacgactacgtcctagg

SEQ ID NO: 265998 - DNA, 571 bp, Homo sapiens
  misc_feature: GYAE6OF02I604Y.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgtgctcttttaagaggtgtccagtgtcaggtgcagctgggtggagtcgtgggggagcgtggcccagccgtgggactccctgagacctctcctgtgcagcgtctggacttccaccttcagtagtcagtggcatcgctacggtcggggtcccgccgaggcctacgagggcaagtggggctgggaggtggggtgctagttatagtggtatgagtggaagtagtactaattactatgacaggtactcggaggacggcctacgttccgaccgtcaccgagacgacaactaccgaacgacacgactgtatccagacaagtacgacctacgtccaggacgacggccgacgacgtacggtcttaacgttagtaacttacgtaggtacggacgaggacgtaacggacgaccgtaaccg

SEQ ID NO: 265999 - DNA, 625 bp, Homo sapiens
  misc_feature: GYAE6OF02FPEE7.34.26.C04.1.454.CMB.1.raw
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagcgtggtggagtcgtgggggaggcgtggccccagcctgggacctccctgacgactctcctgtgcaggcgtcgtggattccaccttcagtatcagtggcatgcacggtgggtcccgccgaggcctaccgaggcgaaggggctagggngtgggtgntaggttatagtgggtatggtagtaggtaagttacgtacaattactagtacgacaagtaccgtcggaggacggccgtactccgaccgtcctacgagacgactaactacccgaagaaccacgactacgtactcgtacgaactaagacgaccgtacgccgtacgaacggccggaaccgacggaccgtaccggtacgttaacgttacgttaaagtttaccggtggtaggtaccggaaggtaaccgggaacggtaacccgaccggacccgttaacgg

SEQ ID NO: 266000 - DNA, 943 bp, Homo sapiens
  misc_feature: GYAE6OF02IHLQV.34.26.C04.1.454.CMB.1.raw
  modified_base (179)..(179): a, c, t, g, unknown or other
  misc_feature (179)..(179): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaaagnggtgtccagtgtcaggtgcagcgtggtggagtcggtgggggagcgtcggcccaggtcccgtcggggaccgttccccgtaggaccgtaccgttccttcccgttgggtacgaccgtacggtccggtttccgtaggggtaactttccctaaccccgttttacgaacgggtttacgtaccctaaggttccggggtactaacggttcggtacccgtaaccccggggtttcggggggtaccccccgtacccggtaacggggtacccctttaccccggggaaacgggggtacccgggtaaaacggggggttcccggttagggggtaaccggggttggggggtttaccgggaaccgttaaggggttttaaagtacgggtttaggggtttaaagttaggggtaaagtttaacggggtaaagtttaacgttaacgtaaaagtttaccgtaaagtcggaaacgtaacggtacccggtttacccgggtaaggggtaaaccgggaccccggtttaacgttaacccgtaccccggttacccgtaacccgaaaggaacccgtaaacccgtaaacccttaacccgaaaaccgtaaccgtaaccggtaccgttagtacctccgtaacgtaacgaaacgtaccgaaccgtaacgtaccgtagtaaaccggaccggaccgaaaccgggtaccgaacccgggttacttaaggttacccgtttaagttaccgtaggtacggtacggtaacggaaccggaacggaaccgaccggtaaccgtaacgg

SEQ ID NO: 266001 - DNA, 646 bp, Homo sapiens
  misc_feature: GYAE6OF02GM8HC.34.26.C04.1.454.CMB.1.raw
  modified_base (161)..(161): a, c, t, g, unknown or other
  misc_feature (161)..(161): n is a, c, g, or t
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (388)..(388): a, c, t, g, unknown or other
  misc_feature (388)..(388): n is a, c, g, or t
  modified_base (493)..(493): a, c, t, g, unknown or other
  misc_feature (493)..(493): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttgcttcttttaagaggtgtccagtgtcaggtgcagctggtggagtcgtgggggagcgtggcccagcccgtgggaccgtccctagacgtacctccgtcctggtcgcaggcgttcgtggtacttccgacctttcgagttagtccagttcggcatcggaccacgttcggggtcccnccgagggtcctccgaaggcgaaggggtctagggnggtggggtgctaagttntagtggtatggagtggagtagactaatacgtagtcgacgtagtacgtcgtaggacggtctacgtaccgaccgtcgacaggacaccgtaaccgtaccgaaagaccncgtacgtctttacacgtcgaactaaacgtaccgaaccgtaccgtcctaagggacgaccgggaaccggaaggtacccgacggtaccttaacgttacggttacttaacgttcggtacggacggacggaagaaccggacgaccgtaccgtaaccgg

SEQ ID NO: 266002 - DNA, 628 bp, Homo sapiens
  misc_feature: GYAE6OF02IGATL.34.26.C04.1.454.CMB.1.raw
  modified_base (164)..(164): a, c, t, g, unknown or other
  misc_feature (164)..(164): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (416)..(416): a, c, t, g, unknown or other
  misc_feature (416)..(416): n is a, c, g, or t
tcagtacacgtgatcacgaccggtgctcgatttagtctagcgactttgggtttgggctgggagaggagcccagcactagacggtcggcggtgtttccattcggtgatcagcactgaacacagaggactcaccagtggagtttgggctggagtctgggttttccncgttgcttcgttttaagaggtntccngtgtcaggtgcagcgtggtggagtcgtgggggacgtcgtcggacccagccgtaggggcttccgngaacgcctctcgngtnacngcgtcgtggacttcactttcgaagtgtcagtcggactagtgcacgtgggtccnccgagtcctccgaggaccgtaggggcttaagggngtgggcgacttaggtaacttgaacgggtntagagtaggaacgtaatcgtaaagttntacgagacgtacgtacgtacggtacggacggtaccgtacgtccgaccgtcgtaacgagaacgtacgaaccgtaccgaaagaccgacgtagtacgtacacgtaagaacctaacgtaccgaacgacgtacggacgagaccgacggacgtaccgacgttcgtagttactacgttacgagacggtacgtacgaacgaccgacctaccgacgtacgg

SEQ ID NO: 266003 - DNA, 725 bp, Homo sapiens
  misc_feature: GYAE6OF02J1OBU.34.26.C04.1.454.CMB.1.raw
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacctccgtgacgactccgtcctgtgcagcgtcgtggattcgaccttnagtagtcagtggcagtgacacgtcgggtcccgcaggtcctccgaggcgaagggcgtagggacggttggggtcgcgtaggttatacgttggtagtgaagtcgggtaaatagtaacgtaaacgttactagttacgactaacggtacccgttacgggtaacggtaacggggtcccgtaacgttacccgtacccggttaccgtaacccgaacgtaccgaaaccgtaaaccgtaaccccgaaacggtaaaccgaaccggttaccgttacgttaacgttaccctaaggtaacctaaacgtacgtaaccctaacgggtaccgttacggaaacgaccgggtaaccggtaaccggacgtacccggtaacgttaacggttaacgttaacgtttacggtccggtaacggacggttaacgaggaacccggttacgacccgttaccgtaaccggg

SEQ ID NO: 266004 - DNA, 758 bp, Homo sapiens
  misc_feature: GYAE6OF02G8YQ3.34.26.C04.1.454.CMB.1.raw
  modified_base (662)..(662): a, c, t, g, unknown or other
  misc_feature (662)..(662): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggttttcctcgtttgcttcgttttaaaggaggttgtccgagttgtcgaggtgcagcgtgggtggagttcggtgggggacggcggtcgggcccacggccgtcggggtaccttcccgtaggaaccgtaccttccgtcccgtaggtcgaccacggtcccttcgtaggtacttccgtaccttcgagtacgtccacgtggactgaccttacggtccgggttacccgtacgtaaccggttaccgggaaggggtacggggtcgttaggggttgggtttcggtttaacgtaacggttagttaaccgggtaggttggtaacggtaggggaactggaaccaacgtaacgtaccgtaccgggaccgttacgtaccgggtaagggaccggtaccgttaacctccccgaccccgtacgaacgaaccgaacccgaaccgaaccaaacgtaaccgacgtaactacgtacgtacgtacgactaaacgcgtaacgacgtcgaagacgacgacggacgacgacgtntacgttactacgttcgagtacgtggaaacggtcggtacgtaacgtaacgtacgttagttacgttttacggttacgtacgttcggtaggtacccggg

SEQ ID NO: 266005 - DNA, 848 bp, Homo sapiens
  misc_feature: GYAE6OF02HC5LG.34.26.C04.1.454.CMB.1.raw
  modified_base (168)..(168): a, c, t, g, unknown or other
  misc_feature (168)..(168): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctcgttgctntttaagagtgtccagtgtcaggtgcagcgtgggtggacgttcggtggggggacgcggtcgggcccgaggcccgtggggaccgttcccgtaggacgtaccttccgtccgtgtcgcgacggcggttcgttcggtacttccgtaacctttcgaggttagtaccagttcgggacctagtacgtccgtaccggtcggggttccccgaccgacgggtcccttacccggacggggaccggaaacgggggtccgttaagggggtacggggttcggggggtacggggtaccttaaggggttttaagttaaggtaggggtttaagtacgggtaaggtttacgggtaaaaggttaacggttaacaaaagtttaaccgttaaggttcggtaaccgaaacgggttaacccggtacccgggtaaggggtaacccggggtaacccgttaacgttaccgtaccccggtttacgtacccgaaacggtaacggtaaaccgtaaaccggtaaccccgtaaaagaaacccgtaccgtaaccggtttaggtaacttacgtacggtaaactaaacgtccgtaaacccgtacgtaccgtagggaacgaccggaaccggtaccggacgtaccggtacgtaacgttagttaacgttacgttacggtcgaacggtaggacggaacgtacgtacgtaccgtaaccgg

SEQ ID NO: 266006 - DNA, 713 bp, Homo sapiens
  misc_feature: GYAE6OF02HBBW3.34.26.C04.1.454.CMB.1.raw
  modified_base (196)..(196): a, c, t, g, unknown or other
  misc_feature (196)..(196): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (402)..(402): a, c, t, g, unknown or other
  misc_feature (402)..(402): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtncagctggtggagtcgtgggggagcggtcggcccagccgtgggacctccctggacgacctcctcctgtgcagcgtctggacttccacctttcagtctcagtgcatcgcacgtgggtcccncgaggtcctccgaggcgaaggggctagggaggtggggngctaggttaatgtggtatggagtaggaaagttcgtacgtaatacgttanacgtacgaacgtacccgtccggtaaggtaaccgggtccgtaaacgttcccgaacccgttcgtaccgaaggtaacgaaccgtaaccgtaacccgaaagtaacccgaccgttacgttacgttaactaccgtagtaaaccgttaaacgtacccgaaccgtaaccgtcccgttaagggaacggtaacccgggaaccgggtaaccgggtaccggtaaccgggttaacttaacggttaccggttaaacgttttcggtacggtacgggtacggaagggttaaccgaacggttaaccggacccggttacccgtaacggg

SEQ ID NO: 266007 - DNA, 634 bp, Homo sapiens
  misc_feature: GYAE6OF02GLXRD.34.26.C04.1.454.CMB.1.raw
  modified_base (197)..(197): a, c, t, g, unknown or other
  misc_feature (197)..(197): n is a, c, g, or t
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagccccagcactagaggtcggcggtgtttccattcggtgatcagcactgaacacagaggactcaccatggagtttgggctgagctgggttttcctcgttgcttcttttaagaggtgtccagtgtcaggtncagctggtgagtcgtgggggagcgtggcccagcctgggaccgtcccngagctctctgtgcagcgtcgtggtacttcaccttnacgtagtcagtggctagtgcacgtgggtcccncgaggcctccgaggccgaaggggtctgggagttgggggcgtactaggtttatagtggtactgtagttaggaagttagtacaattactagtcgacagcctacggaggtaacggccgtcttccgtaccgtcctacgaagaacgtaaccaaacgttacccgaagtaaaccgacgtctagtaactcgtaagaccgtaaagtccgaaccgtacgacccgtagaacggaccgacggtaacggaccgtacggtaaccttaggtacgttaacgttaccggtaggttacggtaccgaaggtaccggaacgtaccgaccggtaccctaaccgg

SEQ ID NO: 266008 - DNA, 703 bp, Homo sapiens
  misc_feature: GYAE6OF02I76BM.34.26.C04.1.454.CMB.1.raw
  modified_base (213)..(213): a, c, t, g, unknown or other
  misc_feature (213)..(213): n is a, c, g, or t
  modified_base (457)..(457): a, c, t, g, unknown or other
  misc_feature (457)..(457): n is a, c, g, or t
  modified_base (556)..(556): a, c, t, g, unknown or other
  misc_feature (556)..(556): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcacatggagtttgggctgagcttgggttttcctcgttgcttcgttttaagaggtcgtcagtgtcagggtgccagtcgttagggngggtacgttcgtgggggggagccggttacggcccgtaggcccgtagggaccgttccctaggaccgtccttcctccgttagcgacgacgtccgttcgtaggtcttaccgtaccttcgtagtacgtctagtaggctagtcggactacgtcgggtccgacctaggccgtcgaggccggtaggggtctaggggtaggtacggggcgtagtaggtttcgaagtggtattacggagttagggtaacgttnaaccgtaaattacctaggtcacgtacggtcgtaccgaggacggtacgtctcgtaccgtcgtacacgacgtaacaccgacaacgactgtaactctacgtnaacgacgttaaacgcgaccgtacgaccgtaaggtaccggaccggtaaccggtacggtaccggaacgttaccgtaaggttaccgttacggttaacgttggaacggtaacggaggaaccgttaacggaccggtactacccggtaaccgg

SEQ ID NO: 266009 - DNA, 748 bp, Homo sapiens
  misc_feature: GYAE6OF02JSL8H.34.26.C04.1.454.CMB.1.raw
  modified_base (177)..(177): a, c, t, g, unknown or other
  misc_feature (177)..(177): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggctcaccatggagtttgggctgagcttgggtttcctcgttgcttcttttaagnggtctccgagtgtcagggtgacacgtctgggtggacgtcggtggggggagtccggtcggaccctaggccgttggggaccttcccgtagacgtactcctaccgtgtgcagtcgttcgtaggtacttccaccttgaacggttacgttacgcgttggcctaagttcgacccgtacggttcggggtaccccgtaaccgtcgggtacctaccggaggggtaccggtaaagggggttccngggggtacggttgggggcggttacgtaggtttaaacgtagttgggtttaagcggtaagttagggaacgttagtaccgaataccgtagtcgtacgtacgtaacgtacggtacggtaaccggtacgttccgtaaccgtcccgtacgaccgtaacgacgtaacccgtaacttaacccggaaacgtaaccgtaccggacgtttacgtactaccggttaacgaacgtaacgtccgaaccgacgtaccggtaacgtaacggaccgtcgggaaccgtaccgtaggtacgtacgttcggtaacgttagtcggtaagtccgagacggttacgactaccgacgtacg

SEQ ID NO: 266010 - DNA, 685 bp, Homo sapiens
  misc_feature: GYAE6OF02GSC83.34.26.C04.1.454.CMB.1.raw
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (326)..(326): a, c, t, g, unknown or other
  misc_feature (326)..(326): n is a, c, g, or t
  modified_base (511)..(511): a, c, t, g, unknown or other
  misc_feature (511)..(511): n is a, c, g, or t
  modified_base (661)..(661): a, c, t, g, unknown or other
  misc_feature (661)..(661): n is a, c, g, or t
tcagtacacgtgatcacgaccggtgctcgatttagtctagcgactttgggttggggctgggagaggagcccagcactagaggtcggcggtgtttccattcggtgatcagcactgaacacagaggactcaccatggagtttgggctgagctgggttttcctcgttgcttctttaagngtntccagtgtcaggtgcagctggtggagtcgtgggggagcgtcggcccagccgtgggactccctgacgactctcctgtgctagcgttcgtggtattccgcctttcaagttcgtacacgtggcctagtcgacgtacggtccggggtaccnccgtacgggtcctaccggaagggaccggtaaacggggtcgttaaggggtcgggtagggggtcggtccgtaaaggtttaagtaggttacggtaagtaggtaacggttaggaaagttacgtactaaagttacctaggtcacgtaacgtccgtacggtacggaacggtacgtactaccggacccgttnaccgaagtaacacctaaactaccgaagtacacgtacgttgaacctacgtcgaaactaagtaccgaccgtagtcctaaggaccgtaacggaccggtaacgcggtaaccgtacgttgtaaacgttagtaaccgtgttaacgacgacgggtanaccggtacgaccctacgtaaccgg

SEQ ID NO: 266011 - DNA, 644 bp, Homo sapiens
  misc_feature: GYAE6OF02GSSA7.34.26.C04.1.454.CMB.1.raw
  modified_base (162)..(162): a, c, t, g, unknown or other
  misc_feature (162)..(162): n is a, c, g, or t
  modified_base (184)..(184): a, c, t, g, unknown or other
  misc_feature (184)..(184): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggtttttccncgttgcttcttttaagaggttntccattgcaggtgcagtcgtggtggagttcgtgggggagcggtcgcccagcccgttgggaccgtccctgagtacctcctcctgtcgcaggtccgttcgtggtacttcctacccgttcgagttacgtcagtggcagtcgcctacggtgggtcccgccgaggcctccgagggccgaaggggcgttgggaggtggggcgacgttagttatagtggtatgtagtaggtaacgtatactaagtaactagtcgacgacgtaccgtacgtagggaacggtcgtactccgtaccgtcctaccgagacgtacaacgtacccgaagaaccgaccgtacgtgtactcgtacaactaacgaccgacctacggaccgtaggacggaccgtaccggacgaccgaccggtacgtaagttaggttacttcgtacggttacgacggacggaaggaaccgacgacccggacctacggg

SEQ ID NO: 266012 - DNA, 673 bp, Homo sapiens
  misc_feature: GYAE6OF02H01QE.34.26.C04.1.454.CMB.1.raw
  modified_base (182)..(182): a, c, t, g, unknown or other
  misc_feature (182)..(182): n is a, c, g, or t
  modified_base (584)..(584): a, c, t, g, unknown or other
  misc_feature (584)..(584): n is a, c, g, or t
  modified_base (660)..(660): a, c, t, g, unknown or other
  misc_feature (660)..(660): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtntccagtgtcaggtgcagctggtggagtcgtggggggagccggtggcccagcccgtgggaccgtccctggacgcctctcctgtcgcgagtcgtctggactttccgtacctttcagttaggttacacgttgggacacgtggaccctaaccgtcggggttccccgacgacgggtccctccgaggacggaaggggccttaggggaggtcggggtggctaaggtttataggttacgggtaatcgtaggtagggtaaatttacggaataaacttacgttaatcggaacaacgtaccggtacgtagggaaccgggtcgtacgtaccgtccgtaactaccgagaccgaactaacctacccgaaacgaaccgaacgtcgttagtactacgtagtaactaacgacgtaaccncgtaccgtaggacgaacgacgaacgacgacggtacgtaacgtagttacgtagttagcgacggagaaccgtagaacncgtaccccgtagg

SEQ ID NO: 266013 - DNA, 780 bp, Homo sapiens
  misc_feature: GYAE6OF02H5KSK.34.26.C04.1.454.CMB.1.raw
  modified_base (320)..(320): a, c, t, g, unknown or other
  misc_feature (320)..(320): n is a, c, g, or t
  modified_base (669)..(669): a, c, t, g, unknown or other
  misc_feature (669)..(669): n is a, c, g, or t
  modified_base (770)..(770): a, c, t, g, unknown or other
  misc_feature (770)..(770): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgttgggtttttcctcgttgccttacgttttaagaggtgtccgagtgtcaggtgcagtcgtggtggagtcgtgggggagtcggtcgacccgagccgtgggaccgtccctggacgtacctcgtacctggtcgtacgacgtcgtccgttgggtaactttccgaccgttttanagttacggtacctaagttcggactaatcgccggtaaccgttcggggtacccgcccgtaacgggccttacccggagggtacggtaaacgggggcttacgggggtagggttttcgggggaacggtacgttaacggtttaagtacggttaggtagtaggagttacgggtaaagttacgtaacgtaaagttacgtaacgtcgaacgtaacgtaccggtccgtaacgggaacgggtaccgttacgttaccgaccggttacctaacgaacgaaccggtaactaaaccgtacccgaaacgtaaccgaaccggttcgttagtaccttcgtaacgtaccgtaaaccgtaccgtaaacnccgttacgacggacggtaacgaccgggaacgacgtacccggtagttaacgttacgtaacttacggtacgcggtacgtaaggaccgtaacgaacggtacccncggttaaccg

SEQ ID NO: 266014 - DNA, 784 bp, Homo sapiens
  misc_feature: GYAE6OF02HGHKI.34.26.C04.1.454.CMB.1.raw
  modified_base (178)..(178): a, c, t, g, unknown or other
  misc_feature (178)..(178): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagctgggttttcctcgttgctcttttaagnggtgtccagtgtcaggtgcgagcgtggtggagtcggtgggggagcgtcggcccaggtccgtgggaccgtcccgtggacgtaccttccgtcctggtcgacgtacggtcgtcgtggtacttccgtaccgttcgaacgttaggtccagttcgggacctagtcgaccaccggttcggggtccccgaccgtaggtcctaccccggagggaccgggtaaagggggtccgtaaggggttggggtggggggtaccgcgtaaaggtttagtaccgggttaggtaagtggaaggttaacgggtaaaaggttaacgtaccgtaaaagttacgttagtacggcgtaacgggttaccgttaccgggtagggaacgggtacccgtagtttacccgtaccggtccgttacgaacggtaaaccgtaactaaacccggtaacccgaaacgaaacccgtaccggttaacgtacgttaagttcccgttaaacgaaccgtaaaacggtcgaaaccgtaccgaccgttcggaacgaccgtaaccgggacgaacccgcgggtttaacctagttaaccggttacttaacgtggtcgaacggaggaagtaccggacgtacgcgtaaccgg

SEQ ID NO: 266015 - DNA, 652 bp, Homo sapiens
  misc_feature: GYAE6OF02HP436.34.26.C04.1.454.CMB.1.raw
  modified_base (178)..(178): a, c, t, g, unknown or other
  misc_feature (178)..(178): n is a, c, g, or t
  modified_base (217)..(217): a, c, t, g, unknown or other
  misc_feature (217)..(217): n is a, c, g, or t
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (433)..(433): a, c, t, g, unknown or other
  misc_feature (433)..(433): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (555)..(555): a, c, t, g, unknown or other
  misc_feature (555)..(555): n is a, c, g, or t
  modified_base (620)..(620): a, c, t, g, unknown or other
  misc_feature (620)..(620): n is a, c, g, or t
  modified_base (641)..(641): a, c, t, g, unknown or other
  misc_feature (641)..(641): n is a, c, g, or t
tcagtacacgtgatcacgaccggtgctcgatttagtctagcgactttgggtttggggcgtgggagaggagcccgagcactagaggtcggcggtgttccattcggtgatcagcactgaacacagaggactcacagtgagtttggctgagtcctgggtttcctcgttgcttactttaagnggtcgtcctagtgtcgaggtcgcagctggtggagttcgngggggagcggtcgaccaggtcccgttagggccgttcccgaggaacgccttcgtcccgtaggtcgccggtaanccggtttaaccgngggttaacgttacctaccgttttccgaaaggttccgttaagcggttggaccgttancgacgttaacgcggggttacccaaacctggccgttcccgaaggacccgaaggggtcctggaagggtttccggggngtactagtaagtcgtagtgagatacggtagaacttntaatntggacncgacgtccgtacgacggtacggtcgtagtaccgtactacgtacgagtacgaacaaccgaacgaagacgctagtancgtacgagactacgtacgacgacgtacgacgagaacgtcgagacgtcgacgtagtactagtacgngtacgaggacgtagaccgganacggactaacg

SEQ ID NO: 266016 - DNA, 730 bp, Homo sapiens
  misc_feature: GYAE6OF02G4MTT.34.26.C04.1.454.CMB.1.raw
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (600)..(600): a, c, t, g, unknown or other
  misc_feature (600)..(600): n is a, c, g, or t
  modified_base (636)..(636): a, c, t, g, unknown or other
  misc_feature (636)..(636): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggtagtttgggctgagcgttgggttttcctcgttgcttacttttaaggaggttgtcctagtgtcaggtgcagtcgtgggtggagttcgtggggggagcggtcgccctaggcccggtggggtaccgtccctaggacgaccttccgtcccgtaggtcgacgtacggtcccggttcgtacggtactttacccgtaccgtttacgaaggttacgtacaggttcggacagttcgccgtacggttccgggcccgaccggacgtctaccggaggacgggaacgggtcgtaggggtacgggttggacggtacttaggttaattcggtaggttacaggtagtagggtaaaacgtagttaaactaacgtctagngtaaacncggttactacggtaggaacgggtccgtactacgtaccgttacgaccgtaagaacgaacaacgtaaccctaaacggaaccacgtacgttataacncgttaagaacctaagccgtaacgacgcgtaaggaanacccggagaacccgttacgaacggtaccttggttaactacttaacggcggttaacggacggaacggagtaaccgaacgtacccaacggtacccg

SEQ ID NO: 266017 - DNA, 729 bp, Homo sapiens
  misc_feature: GYAE6OF02HUIBI.34.26.C04.1.454.CMB.1.raw
  modified_base (172)..(172): a, c, t, g, unknown or other
  misc_feature (172)..(172): n is a, c, g, or t
  modified_base (184)..(184): a, c, t, g, unknown or other
  misc_feature (184)..(184): n is a, c, g, or t
  modified_base (590)..(590): a, c, t, g, unknown or other
  misc_feature (590)..(590): n is a, c, g, or t
tcagtacacgtgatcacgaccggtgctcgatttagtctagcgactttgggtttgggggctggggagaggagcccagcactagaggtcggcggtgtttccattcggtgatcagcactgaaacacagaggactcaccatggagtttgggctgagctgggttttcctcgttgctnttttaagaggtntccagtgtcaggtgcagcgtggtggagtcgtgggggagcgtggcccaagcccgtgggacctcccgtgaacggtactccgttcctggtacggctacgacgtccgtagggtaatttcccaccgtttaccaagttaacgtcacttggctaatgccacgtcgggtccgccgaggcctccgaggtaccgaaaggggtctggaggtggggtcgggactaagttatacgttagggtataggatttagggaaattacgtactaaattacgtaagttcaacgtaaggtaaccccgtcgggtaggaacggggtaacccgtaagttacccgtacccgtccgtaacccaaggaacctaaacctaacgtaccccgaaagaaacccgaacgttccgtacggtttaactcgtaccggtaanaaaaccgttcgaaccgtaccgacctaggaaacgaaccgtcgggaaaccggaccgtagggtaccttaaaggtccgtttaaacggtacccttagggtacgtaccggaagtccgggaaaggaaccgtacgacccctaaacgg

SEQ ID NO: 266018 - DNA, 806 bp, Homo sapiens
  misc_feature: GYAE6OF02ISBI0.34.26.C04.1.454.CMB.1.raw
tcagtacacgtgatcacgaccggtgctcgatttagtctagcgactttgggtttggggcgtgggagaggagcccagcactagaggtcggcggtcgtttccattcggtgatcagcactgaacacagaggactccacagtggagtttggctgagcttgggttttcctcggttcgcttacgttttaaggacggttgtcccgtaggttgttacgagggttcgcgaacgtcgtgggtggacgttcggtagggggacgcggtgaccccgaggccgtgggaccgtcccctaggacgacttccgtacgtggtcgcgtacgcgttccgtggtacttactacccgttcgtaattacgtaccgtacgtggacctaacgtggaccgaccggttggggttaccccgacgtaccggtccgtccgtaacgggtccggaaacggggtcccgtagggtaacgggtttcgggggaggtaccggtaaggtttaacgtaggttacggtagttagggtagtttagggtaacgtacgttaaccgtaacttacgtacgtacgtaaccggacgtaccgtaccgggttaggtaaaccgggtcgttaccttaccgtacccgttccggtacccgaaacggaccgtaaacctaaaccggtaccaaacgtaaccggtacgtacgggttacttacgtaccgtcgtaaacgtacgtaccgaactaccggaccgtaggtacggaacgtaccggaacggtaccgacggtaccgttggttaccttaagtcccgttaggttacggacggaacggtaagacgacccgtacgtacggtaacccg

SEQ ID NO: 266019 - DNA, 881 bp, Homo sapiens
  misc_feature: GYAE6OF02IBOB0.34.26.C04.1.454.CMB.1.raw
  modified_base (176)..(176): a, c, t, g, unknown or other
  misc_feature (176)..(176): n is a, c, g, or t
  modified_base (196)..(196): a, c, t, g, unknown or other
  misc_feature (196)..(196): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcngcgtggtggagtcgtgggggagcggtcggcccagccgtgggactcctgagacctctcctgtcgactaggccgtcgtggactttccaccgtttacaggttagtccaagtcgggtactaacgttggccctaacgtttcgggggtcccccgaccggaacggtcccttccggacggggaacccggtaaagggggtcctaacggggttaggtcgggggtcggaccgttaaagggtttaaacgtacggttagggtttaaacgacgggttaagtaacggggttaaaagtaacggtttacctaaaaacgtttaaccgttaaacggttgaaaccggtaaacggttacccgttaaccggttaaacggggtaaccgggacccggtttaaaccgtttacccgtaaacccggttacccgttaacccggtaaacggacgtaaaccgtaaaacccgttaaaccccgtaaaaccgaaaaccgttacccgtaaaccgtttcgtaaaccgttaccgtttaacgaaacccggttaaacgttaccggaaaccctaacgggttaaccccgttagaaaaccggggttaccgaaccgggtaaacgggtaacccgtaccgggtaacttacggtttacgttaaacgttccggttaagtacccgggtaaggtaacggaaagaaccggtaactacccggcccgttaaacggg

SEQ ID NO: 266020 - DNA, 764 bp, Homo sapiens
  misc_feature: GYAE6OF02H3JHE.34.26.C04.1.454.CMB.1.raw
  modified_base (293)..(293): a, c, t, g, unknown or other
  misc_feature (293)..(293): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttggggttttcctcgttgcttcttttaagaggtgtccagtgtcaggtgcagctgggtgagtcgtgggggagcgtggcccagcccgtgggacgtccctgagactctcctgtgcagcgtctggattcaccttcagtgtcagtggnatgctacgtcggggtccgaccgtagggcctccgacgggtacctaaagggggggcccgttaggggtaacgggttgggggtcgggaccgtaaagggtttaacgtagttagggggtttaacgttggaagtttaacggggtaaaggttacggttaacctaaaattacgttaacgtaggaccgtaaaggttacccgtacccggttagggaaaccggggaccgttaacgtttacccgacccgttccgtacccgaaggtaacgaaacctaaacgtaaccccgaaagtaaaccgaccggtacgtacggtaacttaccggtaacgtaaccgtaaaacgtccgaaaccgtaacgtacccgttaagggaaaccgtcggaaacccgggtaggaccgtaaccgggtaccgttaagttaacggttactttaaccggtcggtacgacgggtaacgaggtaaccggaacccgtacggaccctaacgg

SEQ ID NO: 266021 - DNA, 757 bp, Homo sapiens
  misc_feature: GYAE6OF02FR9MP.34.26.C04.1.454.CMB.1.raw
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
  modified_base (472)..(472): a, c, t, g, unknown or other
  misc_feature (472)..(472): n is a, c, g, or t
  modified_base (616)..(616): a, c, t, g, unknown or other
  misc_feature (616)..(616): n is a, c, g, or t
  modified_base (640)..(640): a, c, t, g, unknown or other
  misc_feature (640)..(640): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcgttgggtttttcctcgttgccttcttttaaaggaggttcgtccagtgtacaggtgcagtctgggtaggagttccgtgggggagcgtcggcccgagccgttgggacctcccgtgacgtacttcgtacctgtgccaggtcgttacgtaggtactttccaaccctttgtaacggttacgtctaagttggcctaattcggacctacggttcgggggccccaccgaggccctccggaaggaccgaaggggtctgggtacggttggggngtacgtagttgtagttaggtnaggtaagtttaggaaggttataccgtaaagttacgtntacggaacttaacggtaccgtacggttacgggacgggtaccccgtttaacgttcccgtacccggttccgtaaccgaacgggtaaccgtaaacccaaaccggttaccccaaaacgacccgttaaccgcgtttaacgagtttaccncggtaaactaacgtcgtaaacccngtaaccgtgaaccggaacgtaccgggacgttaccgacggtacttaacggttacgttaaccgttggtacggtaccggtaggtaacggaccgtacggtaccgaacccgttaccaacggg

SEQ ID NO: 266022 - DNA, 717 bp, Homo sapiens
  misc_feature: GYAE6OF02I6IIA.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggacgtccctgacgactctcctgtcgcagcgtctggattccaccttcagtagtcagtggcagttgaccacgtgggtcccgaccgagggtcctaccgagggacgaaacgggggtcctagggtaggtggggtcgcgtaaggtttatagtaggtataggagttaagggaaagttacgactaaagttaccgtaagtcggactaacggtaccgttaccggtagggtaaaccgggtaccggtaacgtttcccgaacccgttcgtacccgaaacggtaacgtaaacctaaacgttaaccccgaaaacggaaaccctaaccgtaccttaggtaacttaccgtacgaaactaaacgttacgaacccgtaacgtaccctaggaaccggaacgtacccggtaaggacccgtaacggtacttaaggttacgttaaacgtttaccgttgggtaacgtccggaaacggtaaggaacggaaccgtacgtcccgtaaccgg

SEQ ID NO: 266023 - DNA, 664 bp, Homo sapiens
  misc_feature: GYAE6OF02F9L6X.34.26.C04.1.454.CMB.1.raw
  modified_base (198)..(198): a, c, t, g, unknown or other
  misc_feature (198)..(198): n is a, c, g, or t
  modified_base (249)..(249): a, c, t, g, unknown or other
  misc_feature (249)..(249): n is a, c, g, or t
  modified_base (311)..(311): a, c, t, g, unknown or other
  misc_feature (311)..(311): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcgttttaaggaggtgtccagtgtcaggtncgagctggtggagtcgtgggggacgcgtcggcccagccgtgggacctcccngagacttctcgtgtgcagcgtctggattccgaccttcagtagcatggcatgcacgtggtccncgagcctcgaggcgaagggctagggacggtcgggtacgctaggttaatagtgggttatcggtagtacggaagttcgtaataattactagtcgtacgacgtaccgtacggtacggaacgggtaccgtacgttacccgtaccgttctaccggagaaccgaacctaacgtaaccccgaaagtaaccgacgtacgttacgttacttacgtaacgtaacgtaacgttacgaacccgtacggtaccgttacggaacgggaacggttaaccggacgggaacctacgggtactacggttacgttaacgttacgttaggtacggacggtaggaaccggtacgacggtaccgaccgtaaccgg

SEQ ID NO: 266024 - DNA, 818 bp, Homo sapiens
  misc_feature: GYAE6OF02HVXC1.34.26.C04.1.454.CMB.1.raw
  modified_base (161)..(161): a, c, t, g, unknown or other
  misc_feature (161)..(161): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttccncgttagcttacttttaagaggtgtccagtgtcaggtgcagctggtggagtcgtgggggagcgtcggcccaggccgtagggacgtccctgacgacgtcctaccgtgtcgacacgcggtacgttgggtaactttcctacctttacaaggttacggtacagttcgggactaagtcggacctaacggtccggggttacccgaccgacgggtaccttcccgaagggaccgaaagggggtcctaggggacggtacgggggtcgtaacggtagttttaacaggttacgggttaattacgggaagttacggggtaaaagttacggtactaaacgtttaactagtacggacctaacgggaccctttacgggaacggtaacgggtacccggttaactttcccgaaccggtttaccgacccaagggaacgtaacccgtaaaacccgtaacccggaaagttaaccggaaccgtacggtaccgttaacggtcccgttaaagggaacctaaaaggtccgaaaccgacgggttacccgtaggaaaccggaaccggtaccggggaaccggaacgtaccgggttaactaacggtttaaggaaccgttttacggtaacggtaggtaacggtaaccgggaacggaacggaaccgttaccgggaccccttaaacggg

SEQ ID NO: 266025 - DNA, 797 bp, Homo sapiens
  misc_feature: GYAE6OF02GUDGP.34.26.C04.1.454.CMB.1.raw
  modified_base (178)..(178): a, c, t, g, unknown or other
  misc_feature (178)..(178): n is a, c, g, or t
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
  modified_base (425)..(425): a, c, t, g, unknown or other
  misc_feature (425)..(425): n is a, c, g, or t
  modified_base (466)..(466): a, c, t, g, unknown or other
  misc_feature (466)..(466): n is a, c, g, or t
tcagtacacgtgatcacgaccggtgctcgatttagtctagcgactttgggtttgggctgggagaggagcccagcactagaggtcggcggtgttccattcggtgatcagcactgaacacagaggactcaccatggagtttgggctgagcttgggttttcctcgttgcttcttttaaagnggtgtaccagtgtcaggtcnctagtctgggtaggagttcggtagggggacgtcgtcggacccaagtcccgtggggaccctccctaggacaccgttcctaccgtgtacgcgnggtccgtctagggtactttcccgaaccgtttaccagggttacttccgagttcggacctagttcgaccgtacggttccggtcccgaccgtcggtcccaccggaggtaccggagggtctaggggtaggtcgggtacgngttaagtttacagttccggagtcggtaagtagggtaaagtntaaacgttaacgtagttacgcggactaaacggtcccgtacggttaacgggaaccgggtacccttacgttcccgtaacccggtcgtaaaccggacaacggtaaaccctaaacgtaacccgaacgggtaaaccctacggtacctttacggtacgtttaccggaaactaaccggttaaacgtacccggaaaccgtaccgttacgaaacggaccgggaccgggaaccgaaccgggtttaccgaccgttccgttaaagttaccgttaacgttaccgggtagttacccggaaggaacgttaacggaaccggaccgtaaccggtcccgtaaaccgggg

SEQ ID NO: 266026 - DNA, 843 bp, Homo sapiens
  misc_feature: GYAE6OF02GNBOK.34.26.C04.1.454.CMB.1.raw
  modified_base (164)..(164): a, c, t, g, unknown or other
  misc_feature (164)..(164): n is a, c, g, or t
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagtacacgtgatcacgaccggtgctcgatttagtctagcgactttgggtttggggctgggagaggagcccagcactagaggtcggcggtgtttccattcggtgatcgagcactgaacacagaggacctcaccatgggagtttgggctgagctgggttttccncgttgcttacttttaagaggtgtccaggtgtcaggtncagcgtggtgagtcgtgggggagcgtcggcccagcccgttgggacctcctgacgctctcgtgtgcagcgtcgtggattccaccttnaacgttcgctagtcggccagttcggccgtaacgttcggggtcccaccgaacggtctccgacggtacgtagggggacctttcggggaaggttccggggtacgacgttacggttaatacggtgggtttacaggtacggtacggtaaggtacgttacctaaagttaaccgttgttaccggaacgtaaccggttacccggtaccgggttaaacgggtaaccggggttacgttaacccgttaacccggaaacccggtttccgaacccgggtaaacgtaaaccgttaaaccggtaaaacccgtttaaccccgaaaacggtaacccgttaaccgggtaaacccgtttacggttaaccgtacccgtttaaacgggaaacttaaaaccggtttaccggaaacccgtaacgggttacccgtacggttaaaccggaccggtaacccgggtacgggtaaccccgaaccgggtttacgtaaacggttttacggttaacgttacggttacggtacggtaacgtaaccgggttaacggaacggtaacccgtaacggtccccttaaacgggg

SEQ ID NO: 266027 - DNA, 595 bp, Homo sapiens
  misc_feature: GYAE6OF02I20ZL.34.26.C04.1.454.CMB.1.raw
  modified_base (304)..(304): a, c, t, g, unknown or other
  misc_feature (304)..(304): n is a, c, g, or t
  modified_base (345)..(345): a, c, t, g, unknown or other
  misc_feature (345)..(345): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggtttctcgttgctcttttaagaggtgtccagtgtcaggtgcagctggtgagtcgtgggggagcgtggcccagcctgggactccctgacgactctcctgtgcagcgtctggacttccgaccttcagtagtcatggcatgcacgtgggtccncaggctccgaggcgaaggggctgggagtgggtgctagttanacgtggtatgagtaggaagtgtactaagtactagtcgacgaaggtaccgttcggtaggaacgggtcctaagtttccgacccgttctaccgaagtaacgaacctaacgtacccgaaagaacctacgtctacgtactacgtagaacctaaacgtacgaaccgacgccgtaagaacggacgaccgaccggactacggtacttaaggtcttaacgtacgtgtacggacggaacgagtacgacacggccctacgg

SEQ ID NO: 266028 - DNA, 828 bp, Homo sapiens
  misc_feature: GYAE6OF02I5CCC.34.26.C04.1.454.CMB.1.raw
  modified_base (206)..(206): a, c, t, g, unknown or other
  misc_feature (206)..(206): n is a, c, g, or t
  modified_base (582)..(582): a, c, t, g, unknown or other
  misc_feature (582)..(582): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttcctcgttgcttcttttaaggaggtgtccagtgtcaggtgcagcgtggnggagtcgtgggggagtcggtcggcccagccgtgggacctcctgacgtactctcgtgtcgctagcgtgtaggacttccaccttcgaggttatccagttcggactagtcgacgtacggttcggtccgaccgaggtcctcggaaggcggaacggggtcgtaggggtacggttcggggagtactaacggtttagtacggtgggttaactggtaaagtacgggtaaacgtttacgtaactaaagtttaacgtacgtacggtaccgtaagtcccgggtacgggtaacgggaaccccgggttcgttaacgttacccgacccggttcgtaacccgtaaaggttaacccgaaacccgttaaccgtaaccgtaaacggtaaacccnccgttaacgttacgttaaccgtacgttaaaccgaccgtaaaacgggtttaccgacccgggttaacggtacccgttaagggaaacccggtcccgggaaacgggtaaccgggaccccgttaacgggttaactttaccggggtttaaaccgtttaaaccgtcgggttttacccgggaaaccgacggggtaaaaccgggtttaccaaacccggggttaaccctacccgggttaccgtttaaaccccgggg

SEQ ID NO: 266029 - DNA, 744 bp, Homo sapiens
  misc_feature: GYAE6OF02JDFMQ.34.26.C04.1.454.CMB.1.raw
  modified_base (163)..(163): a, c, t, g, unknown or other
  misc_feature (163)..(163): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (325)..(325): a, c, t, g, unknown or other
  misc_feature (325)..(325): n is a, c, g, or t
tcagtacacgtgatcacgaccggtgctcgatttagtctagcgactttgggtttggggctgggagaggagcccagccactagaggtccggcggtgtttccattcggtgatcagcactgaacacagaggactcaccatggagtttgggctgagctgggttttccngttgctcttttaagnggtntccagtgtcaggtgcagctggtggagtcgtgggggagcgtcggccagcccgtagggaccgtccctagacgtactcctccgtgtgcagccgtctggacttccaccgtttcagttacgcatcggactatcgcaccgtgggtcccnccgaggtcctcggacggcgaagggggtctagggtacggttgggggcgacgtaagttacgttaggtagggtatggttaacgtagggtaacgttaagtactaaaagttactaggtacggaccgtaacggtaccgttacccgggtaggtaaccggggtacctaaccggttaccgtacccggttacctaccggaacggtaaccggaaccgttaaccgacccaaacggaacctaaccgaccgttacgtacgtacgttacgaacgtaaacgtaccgaacccgtacgaccgttacggacggaaccggtaccggtaaccggaccgtaaccggtaccgttaacgttaacgggtttaaccttaacgggtacggttaaccgaacggaacggtacggtaaaccggtacgtaacccggtacccgtaaccggg

SEQ ID NO: 266030 - DNA, 847 bp, Homo sapiens
  misc_feature: GYAE6OF02FHAMS.34.26.C04.1.454.CMB.1.raw
  modified_base (297)..(297): a, c, t, g, unknown or other
  misc_feature (297)..(297): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcggtggccccagcctgggacctccctgacgactctcctgtgcagcgtctggattcaccttcagtagtcagtggcatgcncgtcgggtcccgccaggcctccgagggcgaaggggggtctaggggacggttcgggggtgggtaccgtaaggttttaagtaacggttaggggtaattagggaagtttaggggtaaaaggtttacggtaacgtaaaacgttttaaccgtaagttacggaccgtaaacggtaccgttacccggggttaaggaaaccgggggttaccccgggtaaacttttaccccggaaccccggtttcccgggtttaacccgaaacgggtaaaccgtaaacccgtaaaaccgttaaccccggtaaaacggaaacccgttaaaccgggaccgtttaacggttaaccttaccgttacggtaaacctaaacggttacggtaaaccccgtaagaaccccggtagtaaaaccgggaccggtaaccccgggtaacgggaaccccgtaccggggttaacccgtttaaaggttaacggtttaaaccgtttacccggttaaggtaaccgggttaaccgggaacgggaaaccggtaacgggtaaaccccgttacggacccccgtaaacccgg

SEQ ID NO: 266031 - DNA, 720 bp, Homo sapiens
  misc_feature: GYAE6OF02HDK40.34.26.C04.1.454.CMB.1.raw
  modified_base (255)..(255): a, c, t, g, unknown or other
  misc_feature (255)..(255): n is a, c, g, or t
  modified_base (323)..(323): a, c, t, g, unknown or other
  misc_feature (323)..(323): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccagtggagtttcgggctgagctgggttttcctgttgcttcgtttaagagtgtccagtgtcgaggtgacagcgtgggtaggacgtcggtggggggagcgtacggccctaggccgtagggcccttcnggtacgccttccgtccgttaggcacgtaggtcccgttagtcggacttccaacccgtttgagttacgtnagtcggcctagtgccgtacgttcggggcccgcgtacgccgtaccgagggtaccggtaaggggtctagggtaccggtgggggtaccgtgtttaacggtaatttggttccgggttaaagtggtaacggtaggtaaacgtttaaggacctaaaagttccggttatacgaccgtaagtaccgtcgtacggtacggtaccgtactacgtcgtaaaaaaacgtcacgaacgactaacgtaaccgtaacgaacgaccgtacgtagttacgtcgtacgtaacgtaacgacgaaccgtacgtaccgacggtaaccggacgtaaccgtacgtaccgaccgtacggtaacgtagttacgttacgttacgtaggtacgtacggaacggtacgacgtacgaccgtaccgg

SEQ ID NO: 266032 - DNA, 653 bp, Homo sapiens
  misc_feature: GYAE6OF02IC7V6.34.26.C04.1.454.CMB.1.raw
  modified_base (183)..(183): a, c, t, g, unknown or other
  misc_feature (183)..(183): n is a, c, g, or t
  modified_base (232)..(232): a, c, t, g, unknown or other
  misc_feature (232)..(232): n is a, c, g, or t
tcagtacacgtgatcacgaccggtgctcgatttagtctagcgactttgggtttgggggctgggagaggagcccaggcacgtagaggtcggacggtgtttccattcggtgatcagcactgtaacacagaggactcacatggagtttgggctgagctggttttcctcgttgctctttaagaggtntccagtcgtcgaggtgcagcgtggtggagtcgtggggacgcgtcgaccncgtccgtcgggacctcccagacgtacttccttcctggtcacacgtcgttactggtacttcctaccttcaagtagtcagtggcatcgctacgtcggtacgccgtggtcctccggtaggaccggaagggtcgtacgggtaggtcgggtacggtactaagttcgtaggtcggtagtggtacgtaggtaaacggttctaactaagtacctatccgagtacgtaccgtacggtacggaacggtaccgtacgttccgtaaccgtcgaccgtaggacgtaacctacgtaccaaacgtacacgtacgtagtacttacgacgtaatcgtaacgaccgtcgtacgacgacgaacggtaccgagaccgtcggtatacgttacgtcgttacgtcggtacgacgtaacgacgtacgaccgtacgtctaacccgg

SEQ ID NO: 266033 - DNA, 809 bp, Homo sapiens
  misc_feature: GYAE6OF02G2QQ6.34.26.C04.1.454.CMB.1.raw
  modified_base (184)..(184): a, c, t, g, unknown or other
  misc_feature (184)..(184): n is a, c, g, or t
  modified_base (664)..(664): a, c, t, g, unknown or other
  misc_feature (664)..(664): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcggttgcttgttttaagaggtntccgagtgtcaggtgcagtctggtggacgtgtgggggacgcgtcgccagtccgtgggtaccgtccctaggacgtacctcttccgtggtacgcctagtccggttctgggtaactttcccacctttacgaaggttaacgtcgtaacggtcggactacgttacgcccggttacggtaccggggtccccgtaacccggtcgggaccctaacccgggacgggtaccgggtaacgggggtcccgttaaggggtacggggtcgggggttacggaacttaggggtttaaacttacggttagggttaacgttaaggtcgggttaacggtaaacgggttacgttactaaacgttaccgtagtaccgtaccgtacggtaccgtccggtaagggacggcgttaactccgtaccgttcgcgtaagtacgaacctaaccgtaccgaaacgttacacggtcgtacgttaactcgaccgtaactaacgtccgtaanaccgggtactaccgggtcggaaacccggtacggtacccggacgttccggtacgtttaaacccggttggtttaaaccgttcggtacgggttaacgaacggttaacggtaaaccgggaacctaacggacccggttacccgtaacggg

SEQ ID NO: 266034 - DNA, 852 bp, Homo sapiens
  misc_feature: GYAE6OF02JFU39.34.26.C04.1.454.CMB.1.raw
tcagtacacgtgatcacgaccggtgctcgatttagtctagcgactttgggtttgggctgggagaggagcccagcactagaggtcggcggtgtttccattcggtgatcagcactgaacacagaggactcacatggagtttggctgagctgggtttcctcgttgcttcttttaagaggtgtccagtgtcaggtgcagctggtggagtcgtggggggagtcggtcggcccagcccgttggggacccgttccctaggacgaccttccgttccgtggtcgctagtccgttcgtggtacttccgacctttcgaagttacgtacgaagttcggactaagttcggctacggttcgggcccgtaccgagggccttaccggaagggaccgggtaaacggggtcgtagggggtaagggtcggggttacgggacgttaaggtttaacgtaggttagggtttatagggtaaagttagggtaaaagttacggttaacctaaaagttaccgttaagtcggtaaccgtaacgggttaaccgttacccgggtaacggtaacggggtaacccgtaacgtttacccggaaccgtttacccgtacggaaacggtaaaccgaaccgttaaaccgtaacccgtaaaacggaaccgtaaccggttaccgtaggttaacctcgaaacggttaaccaaacgttaccggaaaccttaccgggtaaccgtaagggtaaccggacggttaaccccgggaacggaaccgggttaccgggtacgtttaaagggttaccggtttaacgttaaccggtcggtaacgggttaaccggaaacggaaccgggttaacggaaccggaaccggttacccgtaaaccggg

SEQ ID NO: 266035 - DNA, 597 bp, Homo sapiens
  misc_feature: GYAE6OF02FM8BN.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggcccagcctgggacgtccctgagactctcctgtgcagcgtctggattcaccttcagtagtcatggcatgcacgtggtccgcaggctccgaggcaaggggctgggagtggggtgcagttatagtgggtactgagtggaagttagtcgaaattacgtatggacctaggaccgttccggtaggaacggggtccgaatttccgaccgttactcccgagacgacaacgtacccaaagtaaccgacgctgtactcgtcgaacaactacgaacccgtagacccgtaggagaaccggaccggtaacgggaccgaacgggtaccttaagtacgttaacgttaaccgttggtacgtcggaagtaacggagaaccgagaccctacgg

SEQ ID NO: 266036 - DNA, 727 bp, Homo sapiens
  misc_feature: GYAE6OF02JJETC.34.26.C04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtncagctggtggagtcgtggggggaggccgtgggcccaggcccgtgggggtacctccccgtggaacgaccttccgtccgtgtcggcgaaggtccgttcgtggtacttccacctttcgaaggttagtccatggccattcgctacgtcgggtcccgaccgaggtccgtcgacgggtcgaaacgggggtcttacggggaggttcggggtcggacgtagttaataggttcggtaatcggatcgggtaaaagtacggttacaaagttacgtagtacgacgtaacgtaccgtaccggtaggaaccggtcggtaacgtttccgaaccggttacctacgaacggaacgtaaaccgtaacgttaacccgaaacgtaaccgaacgtctaacggtacttcgtacgactaaacgtacgtaaccgtacgccgttacgacggtaacgaccggtaacggaccgtaacggtacgtaacgttacgttaacgttaacgttacggtacggtaacggtacggaaacgaccgggtaaccgaccgtacctaaccgg

SEQ ID NO: 266037 - DNA, 762 bp, Homo sapiens
  misc_feature: GYAE6OF02G78O5.34.26.C04.1.454.CMB.1.raw
  modified_base (265)..(265): a, c, t, g, unknown or other
  misc_feature (265)..(265): n is a, c, g, or t
  modified_base (378)..(378): a, c, t, g, unknown or other
  misc_feature (378)..(378): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtaggagtcgtgggggagcgtggcccagccgtgggacctcccgtgacgactctcgtgtgacngtcgtcgtggattcaccttcgagtacgtcagtcggacctagtgccacgtcgggtacccgccgagggccctccggaagggccggaaagggggtccgtagggtacggttgggggnggtacgtaggtttaagtagtgggttatcgtaagtaggtaaacgtgtaacaaagtttactagtcgaccgtaaggtaccgtccggtaacggaacgggtaccgtaacgtttaccgacccgttacgtaccgaacgtaacgaaccgtaaccgtaacccgaaagtaaaccgtaccggacgtttacgtaacgttaccgtacgtaaacccgtaaacgtaccgtaacccgtaacgtacccgttacgggaaacgaccgggtacccgggaaacggttaacccggaccgggttaccgttaaccggtttaggtttaaacgtttacccgggtaaggttaccggggaacgggttaaccggttaagggaaccgtaacggtacccgtacccggtaacccgg

SEQ ID NO: 266038 - DNA, 756 bp, Homo sapiens
  misc_feature: GYAE6OF02IBJKB.34.26.C04.1.454.CMB.1.raw
  modified_base (178)..(178): a, c, t, g, unknown or other
  misc_feature (178)..(178): n is a, c, g, or t
  modified_base (197)..(197): a, c, t, g, unknown or other
  misc_feature (197)..(197): n is a, c, g, or t
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (538)..(538): a, c, t, g, unknown or other
  misc_feature (538)..(538): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttgggttttcctgttgcttcgttttaagnggtgtcctagtgtcaggtncaggtctaggtggacgtcgngggggacgtcgtcgggccaggccgtcgggacgtccctagacgtactcgtcctggtacncgacggtccttacggtcggttacttccaccgtttacagttacgtcaagtcggaacctagttcggcccgtaacggttcggggtccccacgacggtccgtacgaccggagggtaacgggtcgtaggggaggttcggggtactacgtaggtttaagttaggtaggttaccgtagacggttaagggtaaattcggaacttaaacgttacgttagacgtacctacgtaccggtaccggtaggaaccgggtctaaccgtccgaccgttnaccgaaggaacctaaacgtacctaaccgaacgtacgcctagtacgtaactcgtaacaaacgttactaccgaaccgtacgttacccggaagtacccggtacggtaaaccggacgttaacccggtacggttatttaaacgggtaacctttttacgggtaattaacccggggagtacgggaaagtacccgggttaaggacccgtaaccggccgttaccggg

SEQ ID NO: 266039 - DNA, 903 bp, Homo sapiens
  misc_feature: GYAE6OF02IJ9IV.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagtcgttgggtttttccctcggttgcttacgtttttaagaggttcgtccaggttgtccgaggtgcagtcgtgggtggtaggttcggtggggggaggccggttacgggcccaggtcccgtagggaccgttcccgtggacgaccttccgttccgtggtagccgtacggtccggttcgttagggtactttcctaccctttaccgaagggttaacttcgaacgttcgggaccagtttcgccccgttaacggttcccgggggttcccacccggtaggtcccttaccggaacgggtaccggaacgggggtccgttaggggtacggggttcggggggtagtacgtaacggttttaacgttaaggttccggggttaagtacgggtaacgttaggggttaaaacgtaccgtaacgttaaattacgttacggtacgaacgtacctacccggttacgggtacgggtaaacccgggtacgttacccgttaccggttaacccgtacccgttacgggaaacgtacggaaactaaaccccggttaacccgaaaacgtaccgacgtacgttaacgtaccttaacgaccgtaacccgaaacgttaccgaaacccgtaccttaccggtacgggaaaaccgtaccggacccgggtaaaggacccggtacccgttacggttaacctaaacgggtttacgttacccggttagggacccggttaacggaaacgggaccggtaacccggaacgtaaccccgggtacgttaaccccggg

SEQ ID NO: 266040 - DNA, 932 bp, Homo sapiens
  misc_feature: GYAE6OF02GJ2DY.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcgttttaagaggtgtccagtgtcagggtgcagcgtggtggagttcgtgggggagcgtcggaccccaggcccgtgggaccgtccccgtaggacgtaccttccgttcccgtggtcggccgtacggtccggttcgtacgggtactttacccgaaccctttcgtaaggttacgtcctaaggttcgggacctagttccggaccgtaaccgggttccggggttcccgaccccggtaaggggtcccttcccgggaaacggggtcccgggaaaacggggggtccgttacgggggtaacggggtttacgggggtcggggaaccttaaggttttaacgttaggttacgggggtttaatacggggtaaaggtttaccggggttaaaaagttttaccggtaaccttaaaagtttaacccggttaaggtaccggtaacccgtaacggtttaacccgttacccggggttagggaaaccggggtccccgttaacgttaaccccggtacccggttaacccttacccggaaaccggtaaaccgtaaaccccgtaaacccggttaaccccgtaaaaacggtacccgtaaccgttacccgtttagggttaaacccttccgggtaacctaaaccgtaaaccgttaccgtaaacccgtcggtaacccgttaggaaccggtacggaacccgggtaacgaccgtaccggtactttaagtacggtttaaccttacggtacgggtccgtaaggacgacggtaaccggactacgtaccccggtaacgg

SEQ ID NO: 266041 - DNA, 811 bp, Homo sapiens
  misc_feature: GYAE6OF02H7JLC.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgagcttgggttttcctcgttgcttcttttaagaggttgtccagtgtcaggtgcagctggtggagtcgtgggggagcgtcggcccagccgtgggaccgtccctagacgtaccttcctccgtgtcgcgacggtccgtcgtaggtacttccaccctttcaaggttacgttacattcgggactacgtgccctacggtcggggtaccccgccgaagggtcccctaccgacgggcggtaaacgggggtctaggggtacgggttcgggggtcggacgttaaggtttacgttaggttcgggttaagtaggtaagttagggtaaaagttacggttactaaactttaacgttagttcggacgtaaccggtaccgttaccgggttacgggtaaccggggtcccgttaacgttacccggtacccggttacgtaccccgaacggtaaacgaaccgtaacccgtaaaccccgtaaacgaaaccggtaccgtacgttacggttaaccttcgtaacgaacctaaagtaccgtaaacccgtacgtacccgttaggacggtaacccggtaccggacggaaccgaccgggttacgttacggttaacggtttaacgttaccgttacgggtacggtaccggtaacggtaacggtaccgaaccggtacccgtacccgttaacccgg

SEQ ID NO: 266042 - DNA, 659 bp, Homo sapiens
  misc_feature: GYAE6OF02I1A4N.34.26.C04.1.454.CMB.1.raw
  modified_base (218)..(218): a, c, t, g, unknown or other
  misc_feature (218)..(218): n is a, c, g, or t
  modified_base (228)..(228): a, c, t, g, unknown or other
  misc_feature (228)..(228): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgctcttttaagaggtcgtccagtgtcaggtgcagctggtggagtcgtgggggngcgtggcccngcctgggactccctgacgcctctcctgtgcagcgtntggacttcaccttnagtgtcatcggacagtcgctacggtcggtcccgcacggtcctccgaaggccggaagggggtctagggggaggttgggggtcgggtactaaggtttatacgttggggtaatggtagtagggtaaatagtaaccaagttaactgtacgacctacggtaccgtacggtacggaacgggaccgtacgttaccgtaccgtaccgtacgtaacgaaccgtaaccaaccgttacccgaaacgaaccgaccgtactacgtacgttacgtacgaaccgtaagtaccgaaccgacgtaccgacggtacgaacggaccgaacggacgaccggtactaacgttagttaacgttagtcggtagacggtacggacggacgtacgaccgacctacg

SEQ ID NO: 266043 - DNA, 734 bp, Homo sapiens
  misc_feature: GYAE6OF02FKOKY.34.26.C04.1.454.CMB.1.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (313)..(313): a, c, t, g, unknown or other
  misc_feature (313)..(313): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctggttttcctcgttgctctttaagaggtgtccagtgtcaggtgcagctggtggagtcgtgggggaggcgtggcccagccgtgggacctccctgagactctcctgtcgcagcgtctggacttccaccttnagttacgtnattggccatcgcacgtcgggtcccncgacggcctccggaggaccgaaaggggtctgggtaaggtcggggtcggacgtaaggtttagtaagtaggttaagtggtaagttacgggaaagttacggtaactaaagtacgttagtagaccgtaagaccgttccggtaaggaaccgggtcctaacgttcccgacccgtaccgtcgaacgaaccgaaactaaaccgtacccaaacggaaacccgaaccgtcgttaacgtaacttaccggtacgtaaaccaaacgttcgaaacccgtaacggtccctaaggggaaacggtaaccggaacccgggtaacggaacccggtaaccggtaacggtttaacgttaacggttaaaccgtttaacccgtgggtaacccgtacggaaagggtaaaccggaacggtaaccccgaacggtacccctaaccggg

SEQ ID NO: 266044 - DNA, 748 bp, Homo sapiens
  misc_feature: GYAE6OF02IQZNV.34.26.C04.1.454.CMB.1.raw
  modified_base (276)..(276): a, c, t, g, unknown or other
  misc_feature (276)..(276): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacatggagtttgggctgagctgggtttttcctcgttgcttcttttaaagaggtgtccagtgtcaggtgcagcgtggtggagtcgtgggggagcggtcggcccaggccgtgggaccgtccctgacgacctctccgtgtcgcagcgtcngacttccgaccttcgagttagcagtggacagtcgactacggtcgggtccgaccgaggcctaccgagggacgaaaggggtcgtagggacggttggggtcggactaggtttaatagtacggttaatggtaagttagggaaagttaacgtaactaaaacgttacgtaagtacggaccgtaaaggtacccgttaccgggtaaggggaaaccggggtccgtaaacgtttcccgaaaccgttccctaaccggaaggaaaccgtaaacctaaaccgttaaccccgaaaagaaacccgtaccgtacgttacggtaactcgtaacgaaactaaaacgtacgaacccgtacgaaccgtaggaaccggtaacgaccgggaaagggaccctaacgggtaacgtttaagttaacggttaaaccgtttacgtgggttaacggaaccggtaaggaaccggaaccgtaaccgtaccgacccgtaacgg

SEQ ID NO: 266045 - DNA, 676 bp, Homo sapiens
  misc_feature: GYAE6OF02IH6OA.34.26.C04.1.454.CMB.1.raw
  modified_base (195)..(195): a, c, t, g, unknown or other
  misc_feature (195)..(195): n is a, c, g, or t
  modified_base (390)..(390): a, c, t, g, unknown or other
  misc_feature (390)..(390): n is a, c, g, or t
  modified_base (661)..(661): a, c, t, g, unknown or other
  misc_feature (661)..(661): n is a, c, g, or t
tcagtacacgtgatcacgaccggtgctcgatttagtctagcgactttgggttggggctgggagaggagcccagcactagaggtcggcggtgtttccattcggtgatcagcactgaacacagaggactcaccatggagtttgggctgagctgggttttcctcgttgcttactttaagaggtgtccagtgtcaggtncagctggtggagtcgtggggagcgtcggcccagccgtagggactccctggacgtctcgtcctgtgactagtccgtcgtggtacttccaccgttcagttacgtcagtacggcagttacggcctacggtcgggtccgaccgtaggtcctaccggagggacaaacgggggtctgggtacggtgggtcgacgtagttanagtcggtatcgagtagaacgttactagtaattcgtaagtcgaacgtacggtacgtacccggtagggaaccgggtccgtaaccgtttccgtaccgtccgttaaccgaaggtacgaaaccaaccgtaacccgaaagaacccgtaccgtacgttacgtacgttccgtaagaacgttaacgacgtaccaccgtcgaagtaccggacgacgtaggaccgcgttacgtagtacgtttacgtaaccgttagtccggacggaagtaaccgacggtaacnccggtaccgtaccgg

SEQ ID NO: 266046 - DNA, 896 bp, Homo sapiens
  misc_feature: GYAE6OF02JKQXR.34.26.C04.1.454.CMB.1.raw
  modified_base (282)..(282): a, c, t, g, unknown or other
  misc_feature (282)..(282): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggacctcaccgatggagtttgggctgacgcgttgggttttcctcgttgtccttacgtttttaagacggttgtccaggttgtcgtagggtgctaggtccttgggtcggaggttcgtcggggggaggtccgtggccccaggcccgttggggaccttcccgnggtaacgccttcgtcccgtggttgccaggtccgttctggtacttccgaactttcagtagtcatcggcacgttcgcgtacgtcgggtaccccgtcgaagggtcctaccggagggacgtaacggggtcggtacggnggttacggggtccgacggtagtttaanaggttagggttacnggtaagttagggtaaagttacggaataacggttatacggtagctaagttcccggtaccggtaaaggtaccgggccgttaaccgttaaccctacccggttacctaccggtaaacgtaacggaaccttaaacgtaaccccgaaaacgtaacccgtaccggttaacgttacgggtttaacccgtacgttaaccgggaaacccttaaaggtaccccggtaaaacgttccggttaacccggaagggtaaaccccgggttaaagggaccccgggtaaaacgggtaccccccgggttaaggtacccgggggttttaaaacgttttaaccggtttaaaccggtttccggggttaaacggggttaaccgggaaaccgggttttacccggggaaacccggaacccgggtaaccgggtttacccccgggaaccccgtttaaaccccgggg

SEQ ID NO: 266047 - DNA, 594 bp, Homo sapiens
  misc_feature: GYAE6OF02FUT5U.34.26.C04.1.454.CMB.1.raw
  modified_base (163)..(163): a, c, t, g, unknown or other
  misc_feature (163)..(163): n is a, c, g, or t
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (344)..(344): a, c, t, g, unknown or other
  misc_feature (344)..(344): n is a, c, g, or t
tcagtacacgtgatcacgaccggtgctcgatttagtctagcgactttgggtttggggctagggagaggagcccagcacctagaggtcggcggtgtttccattcggtgatcagcactgaacacagaggactcaccatggagtttgggctgagctgggttttccncgttgctcttttaagaggtgtccagtgtcaggtncagctggtggagtcgtgggggagcgtggccccagcctgggacgtccctgacgtacctctcctgtgcagcgtntggattccaccttcagtagtcagtggcatgcacgtgggtccgcaggcctccgaggcaagggctagggagtggggngctagttatagtggtatgagtaggaagtcgtacaatacgtagtgccaagccgtacggtaggaacgggtcctattaccgaccgtctaccgaagaacgaacctaacgtacccgaaagaaccacgtacgtgtaacgtcgttacgaactaacgtacgaccgacgtccgtagaacgacgaccggagccgtaacggtacttacgtagttacttacgtgtacgacggtaggtaacggacgacgtacgaccctaacgg

SEQ ID NO: 266048 - DNA, 813 bp, Homo sapiens
  misc_feature: GYAE6OF02IW5DV.34.26.C04.1.454.CMB.1.raw
  modified_base (230)..(230): a, c, t, g, unknown or other
  misc_feature (230)..(230): n is a, c, g, or t
  modified_base (457)..(457): a, c, t, g, unknown or other
  misc_feature (457)..(457): n is a, c, g, or t
  modified_base (641)..(641): a, c, t, g, unknown or other
  misc_feature (641)..(641): n is a, c, g, or t
tcagtacacgtgatcacgaccggtgctcgatttagtctagcgactttgggtttggggctgggagaggagcccagcactagaggtcggcggtgtttccattcggtggatcagtcactgaaacacagaggaccttcgaacattggaagttttcggctagacgtcgttcgggttttaccctcggttcgtctacgtttttaaaggcggtcgtcccaggttcgtccaagggttcncgtagccgtgggtcggaggttcggttaggggggaggtcccggttcgggacccctaggtccctaccggggttaacgttccccgtggaacgtaccttccgtccgtgtcgcgcgtcgtctaggtaccttaccgttccctaggtaccgtgtacctcgtggtaccagtccgtacgtaaccggtcgggttaccgtaccgacggtacccgtcgacggccggtaaggggtacccnggggtaaggtgggttccggacttaccggtaagtttaccggtgggttaacgtgttaaggtaacgggtacgttaacgtagtaaacttacgttagaccgtacgtaagtacccggtcgtaacggaacggtaccgttacgttacgtacccgtctacgaagtccgtaaactcgacctaaagtactaaccngttaccggtactccggtaataccgtaacgttacaacccggttcgaacgtacggacgggaaccgttaacccgggaccgtagtaaacccgttcgttaacggttaaacgttaccgttaacgagttaccggaccgttaaagggccccgaacgttaacggccggtaactaacccggg

SEQ ID NO: 266049 - DNA, 730 bp, Homo sapiens
  misc_feature: GYAE6OF02FNP5Q.34.26.C04.1.454.CMB.1.raw
  modified_base (162)..(162): a, c, t, g, unknown or other
  misc_feature (162)..(162): n is a, c, g, or t
  modified_base (275)..(275): a, c, t, g, unknown or other
  misc_feature (275)..(275): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcctgggttttccncgttgctcttttaagagtgtccagtgtcagtgcagctggtgagtctgggggagcggtggcccagcctggggtacctccgtgagtacctctcgtgtacgcacgtcgttactggnttactaccttacgtagtagttacagttggctaagtcgacgacgtcgggttacccgccgaggtccgttaccgagggacccgtaaagggggccttagggacggtttgggggtagtaacccgtagtttacgtaagttggttaagttcgaagtcggtaaggtacgtagtaaactacttacggtagcctaaaggccgtttacggaggtaacggaacccgtacgttaccctacgggttcctaccggtaaacgtacgaaaccgtaactaacccgaaagtaaaccgaccgttaacgttacgtaacgttacgtacgtaaccgtaatcggtaacccaaggtccccgtaaggaacgacgggtaaccgagacccgtaggtacccgttaagtaccggtttaaacgttacgttaccggtaggttaccgaacgggtacgaaacggttacccggagttaacccgtaaccgg

SEQ ID NO: 266050 - DNA, 605 bp, Homo sapiens
  misc_feature: GYAE6OF02GEQ6N.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttttcctcgttgcttctttttaaagaggtgtccagtgtcaggtgcagcgtggtggagtcgtgggggagcgtcggcccagcctgggacgtccctgagactctctgtgcagcgtctggacttcaccttgagtagtcagtggcagtgactacgtcgggtacccgccaggcctccgaggcgtaaaggggctagggtaggtggggtacgactaaggtttataggttaggtataggagtagggaattacgtaactaagtactagtcgacagtaccgtacgtaggaacgggtacgtactccgtaccgtctacgaagacgtaacaacgtacccaaacgaaccacgctagtactgagactaatcgaacacgtacgagacgacggaccggacggaccgtaacggtactaagtacgttaacgttacgtggtagacggtaggagacgacgtaccgcctacg

SEQ ID NO: 266051 - DNA, 886 bp, Homo sapiens
  misc_feature: GYAE6OF02GP9UF.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctgttgcttcttttaagaggtgtccagtgtcaggtgcagcgtggtggagtcgtgggggagcggtggcccaggccgtgggaccgtcccgtgagacctcctccgtgtgcagcgttctggacttccaccgtttcagttacgtcagtcggctatcggacctaccggtcggggtccccaccgaggcctaccggaacgggcggtaaacgggggcgttaggggacgggttcgggggtacgggaccttaaggtttaagttaggtagggtttaaacgtggtaacggttaaggggtaaaagtttaccggtaaacgtaaacgtttaaaccgtaggtacgtaaccggtaacggttaaccccggtttaccggtaaacggggtaaacccggggtaccccgtttaacgtttacccccgtaaacccgggtttacccgttaacccggaaacgggtaaacccgtaaacccgttaaaacccgtaaaccccggtaaaaccgtaaaccggtacccgttaaccgttaacgtttaaccggttaccgtaacggtaaacccgtaaaagttcccgaaacccgttaaccggtcccgtaacgggtaaggaaccccgggtacccgggaacgggtaaccgggtaaccggttaccggtttaacggtttacggttaaaccgtttacgggttacggttaccgggaacggtagggtaaacccggaacgggtaaacccgtaccccgggtacgttaacccgg

SEQ ID NO: 266052 - DNA, 617 bp, Homo sapiens
  misc_feature: GYAE6OF02F5T8J.34.26.C04.1.454.CMB.1.raw
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagcgtggtggagtcgtgggggaggcgtggccccagccgtgggacctccctgacgacctctcctgtgcagcgtcgtgattccaccttcagttcgtcatggcatgccacgtcgggtccgccgaggcctccgaggaccgaagggggtctagggacggtgggggtagtcgtaggttatagtaggttanggtagtaggaagtagtacgtaaatacttangacagaccgtcgtacggaggcgtatccgtacgtcacgacgagtaacaacgtaccaagaacacgctagtacctacgtacgactaaactcgaaccgaacgtacccggtaagtaccggaacgacccgggaacgaccgtaacggtacttaagtacgttacgttaagtcgttagacggtacggaacggaacgacgtaaccgacccgtaacgg

SEQ ID NO: 266053 - DNA, 696 bp, Homo sapiens
  misc_feature: GYAE6OF02FUXIQ.34.26.C04.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
  modified_base (191)..(191): a, c, t, g, unknown or other
  misc_feature (191)..(191): n is a, c, g, or t
  modified_base (563)..(563): a, c, t, g, unknown or other
  misc_feature (563)..(563): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctggttttccngttgctctttagaggtntccagtgtcaggtncagctggtggagtcgtgggggagcgtggccccagctggggactccctgagacctctccgtgtcgctacggtccgtctagggtactttccgtacctttacgacggttaacgtcctaagttcgggactacgttcggacccgtaccgggttccgggacccggtacgccggtccgaacggcggggtaacgggtacgggtcggtagggtggggtcgggggtacgtacgttaaggtttacgtaaggtttcggtagtaggtacggtttagggaaacggttataccgttaacttagttagccgtactaccgtcggtacggtacgggacggtacgtctaccgtccttaccgcggtaagaccgtaacgtaacctaacggaanacggtctcttagtactacgtacactaacgtccgacgcgtacggtagacggccgaggtaaccgacggtacgacgttattaaccggtcgttaacggtcggtcgaacggtacggaacgacgtacgcctacgtacgg

SEQ ID NO: 266054 - DNA, 820 bp, Homo sapiens
  misc_feature: GYAE6OF02GUPXO.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggttttccctcgttgcttactttttaaggaggttcgtccgagtgtcgaggtgcagcgttgggtggacgttcgttgggggaggtccggttggaccccaggtcccgtggggaccgttccccgtggaacgtaccttcctccgtggtcgcgtagccgttcgtggtacttcctaccttcgtaggtacgtcagtggcagtcgcgtacggtcgggtacccgccgacggtcctcggaggacggaacggggtctacgggggtaggtgggggtacggtacgtaaggtttagttacggttagggttacgtaggtaggttacgggtaaaagttacgttaaccgtaaagtttacgtaagtacggaaccgtaacggtacgttaccggtacgggaaaccgggtccgtaacgttcccgtacccgttaccgtacgaacgtaacgaacctaaaccgtaacccgaaacgtaacctaaccggtacctttaacgtaccgtaccgttaacgaaccgttaaacgtacccgtaacccgtaacggtacccgttacggaaccggaacccgggtaacccggggacgtacccgggtaacggttacgttaacggttacgttaaacgtttccggttaaggtaccgggtaacgggtaacggtaaggaacccgttacgggacccgtacgtaaccccgg

SEQ ID NO: 266055 - DNA, 624 bp, Homo sapiens
  misc_feature: GYAE6OF02ILK8Z.34.26.C04.1.454.CMB.1.raw
  modified_base (198)..(198): a, c, t, g, unknown or other
  misc_feature (198)..(198): n is a, c, g, or t
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctctttaagaggtgtccagtgtcaggtgcagntggtggagtcgtgggggagcgtggccagccgtgggaccgtcccgtggacgacctctcctgngcagcgtctggacttccacttnagtagtctatggcaacgtgccgtacgttcggggtcccgccggacggtcctccggagggaccgaagggggtctaggggtaggtgggggtggacctaggttatacggttggtagtaggaggttcggaaaggttcgtaacaagttactagttcgacgttacgacgttccggtaggacgggtcctaagttccaccggtcaccgagacgtaacaaccgtaccgaaagaacctggtactagtactcacgaacaagtccgacctacggactgggaaacgtcggacgtagaccgtacgtgtaatagtaacttcgtacgagtcgaggtaacgactaggacctcccgtaacgg

SEQ ID NO: 266056 - DNA, 776 bp, Homo sapiens
  misc_feature: GYAE6OF02GPNI9.34.26.C04.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctgagnttgggtttttccacggtttgacttcgttttaagaggttgtccagtgtcaggtncagtcgtggtggagtcgtgggggagtcggtcggacccaggcccgtggggaccttcccgtggacgacctctccgtagtcgacacggcgtcgtaggtacttccaccgttcaggttacgtacgagttcggacaagttcgacccgtaacggttcgggtaccccgaccgtacggtcccgtaaccggacgggacggtaaccggggtccgtaagggggtaacgggttcggggaacggttaccgttaggttttaaacgtgggttaacggtgtaggtaaggttacggggtaaaactttaggtaaacctaagtttaaccttaggttaccggaacgtacggttaacccggttaccggggaaacggtaaccggggtaccccgtaaagtttcccggtaaacccggttaccgtacccgaaagaccgttaaccgtaaaccgttaacccgaaacgtacccgtaacgtacgtagttacctacgtaactacgtaagtccgaaacgtacgcgttaaggacaacgacggacgacgacgtacgtaagttaggttactacgttcgacgtacgaggtacgaggacctcggacttcgg

SEQ ID NO: 266057 - DNA, 720 bp, Homo sapiens
  misc_feature: GYAE6OF02JM6H1.34.26.C04.1.454.CMB.1.raw
  modified_base (335)..(335): a, c, t, g, unknown or other
  misc_feature (335)..(335): n is a, c, g, or t
  modified_base (452)..(452): a, c, t, g, unknown or other
  misc_feature (452)..(452): n is a, c, g, or t
  modified_base (486)..(486): a, c, t, g, unknown or other
  misc_feature (486)..(486): n is a, c, g, or t
  modified_base (699)..(699): a, c, t, g, unknown or other
  misc_feature (699)..(699): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgcttacgttttaagaggtgtccagttgtcaggtcgcagtcgtgggtggagttcgtgggggacgcgtcggcccaggccgttacggggacctcccgtgacgccttcctccgtgtcgacacggccgttcgtaggtaccttcctaaccttgaacggttacgtcacgttgaccngttacgccgtacgttcggggtccccaccgtcggtcctacggacgggtaccggtaaggggtcgttaggggacgggtttggggtcgtaccgtttaagggttaactaggtcggtttaagnggttaagtacggttaagtacgtataacgttacgnggcgtacgtacgtaccgtcgggtacggtaacgtaccgtaccgtaccgtaccgtacgaacgacgtaaccgaaccgtaaccgtaaccgaaacgtaccgtcgtacgtagtacgtactacgtaacctaacgacgtaaccgtacgtacgtacggaccgacggaaccggtaccgacgtacgtacgttagttacgttacgttacgtacgtagtagacggngaaccgacgaccgacgtacgg

SEQ ID NO: 266058 - DNA, 754 bp, Homo sapiens
  misc_feature: GYAE6OF02JRMK6.34.26.C04.1.454.CMB.1.raw
  modified_base (150)..(150): a, c, t, g, unknown or other
  misc_feature (150)..(150): n is a, c, g, or t
  modified_base (163)..(163): a, c, t, g, unknown or other
  misc_feature (163)..(163): n is a, c, g, or t
  modified_base (181)..(181): a, c, t, g, unknown or other
  misc_feature (181)..(181): n is a, c, g, or t
  modified_base (721)..(721): a, c, t, g, unknown or other
  misc_feature (721)..(721): n is a, c, g, or t
  modified_base (731)..(731): a, c, t, g, unknown or other
  misc_feature (731)..(731): n is a, c, g, or t
tcagtacacgtgatcacgaccggtgctcgatttagtctagcgactttgggtttggggctgggagaggagcccagcactagaggtcggcggtgtttccattcggtgatcgagcactgaacacgagaggactcaccatggagtttgggctgngctgggttttccngttgcttcgttttaaagnggtcgtccagtgtcaggtgcagctggtggagtcggtgggggagcgtcggcccgagccgtgggacgtccctgacgtactctcctagtgaccagtccgtcgtaggtccttactaacccgtttcgaaacggtttcgtaccttaagtccggtactacgtcggacccgacggttcgggtcccccgaaccggacgggtaccctaccgggaggggacccggtaaacgggggtcgttacggggagggttccggggtaggtaccgtaagggtttacttaggtacggtctaaggtagtacgggaagttaacggacctaaagtttacgtaactcggtaaaccgtcggtaacccgtacgggtacgggtaaaccgggtacgttccgtaaacccgtccgtttaaccggtacaaacggtaccgaaactaacccgttaaccgaaacgtaaaccaccgtagtacgttaacgcgttaccgaagtaaacctcggaaccctaggacccgtaggaccgaacgtacccggaagtacgacgttacgtgtaaccgttaagtcgnggtacgaacncggagtacaacgacgccgtaacg

SEQ ID NO: 266059 - DNA, 668 bp, Homo sapiens
  misc_feature: GYAE6OF02I5414.34.26.C04.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (260)..(260): a, c, t, g, unknown or other
  misc_feature (260)..(260): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtgtccagtgtcaggtncagcgtggtggagtcgtgggggagtcgtggcccagtccgtgggacctccctgagcctctctgtncagcgtcgtgtacttccaccttcagttacgtcagtggacctagttcgacctaccggttcggggccccaccggaggtccctacggagggaccggaaaggggtctaggggtacggttggggacgtacgtaagtttagtagttcgggtaatcgggaagttagggtaaactacggtaactaaacgttacgtaggtacgacgtaaacggtccgttaccgggtaagggaaccgggtaccgtacgttacccgtaccgttccgtacgaacggactaaccaacgtacccaaagtacccacgtctagtactacgacgaactagaccgtacacgaccgtagacgacgacgtaacgccgacggttactaagttcgttaactgtacggtagacggaagtacgacgtacacgacccgtacgg

SEQ ID NO: 266060 - DNA, 624 bp, Homo sapiens
  misc_feature: GYAE6OF02GJPY9.34.26.C04.1.454.CMB.1.raw
  modified_base (168)..(168): a, c, t, g, unknown or other
  misc_feature (168)..(168): n is a, c, g, or t
  modified_base (180)..(180): a, c, t, g, unknown or other
  misc_feature (180)..(180): n is a, c, g, or t
  modified_base (221)..(221): a, c, t, g, unknown or other
  misc_feature (221)..(221): n is a, c, g, or t
  modified_base (365)..(365): a, c, t, g, unknown or other
  misc_feature (365)..(365): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (501)..(501): a, c, t, g, unknown or other
  misc_feature (501)..(501): n is a, c, g, or t
tcagtacacgtgatcacgaccggtgctcgatttagtctagcgactttgggtttggggcgtgggagaggagcccagcactagaggtcggcggtgttccattcggtgatcagccactgaacacagaggactcaccatggagtttgggctgagcctgggttttcctcgttnctacttttaagnggttgtccaggtgtcaggtgcagctggtgagtcgtgggggngccgtggcccagcctgggaccgtccctgacgactctccgtgtacgccaggtccgtcgtacggatttaccaccgttttaccgaaggttaaggtccctaagttgggacctaagttcggaccctaaccgttcgggggtaccccgganaccttcggataccgngtcncgtagacacggcacncggatcgctacgcgngtaacnacgcncgcgtcgacgacgtatagtactacgtacgtctactacgacgacgtacgtactacacgacgtacgtacgtacgacgngcgtacacgacgcgacgtacgtacgtagtacgtacgtcgtacgtacgtacgtactacgtaacgaacgtacggtacgtagtaaccgtcgtacgtacggtaacgtaccgtacgacgtacgtacgg

SEQ ID NO: 266061 - DNA, 668 bp, Homo sapiens
  misc_feature: GYAE6OF02JQ1WR.34.26.C04.1.454.CMB.1.raw
  modified_base (283)..(283): a, c, t, g, unknown or other
  misc_feature (283)..(283): n is a, c, g, or t
  modified_base (346)..(346): a, c, t, g, unknown or other
  misc_feature (346)..(346): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
  modified_base (466)..(466): a, c, t, g, unknown or other
  misc_feature (466)..(466): n is a, c, g, or t
  modified_base (639)..(639): a, c, t, g, unknown or other
  misc_feature (639)..(639): n is a, c, g, or t
tcagtacacgtgatcacgaccggtgctcgatttagtctagcgactttgggtttggggtcgtgggagaggagcccagcactagaggtcggcggtgtttccattcggtgatcagcactgaacacagaggactcaccatggaggtttggcgtgagcttggggtttttccctggttcgtcttctttttaagtagggtcgtccgagtgtcgaggtgacgaacggctgggtgggaacttcggtgggggggatccggtaggccccaggtccgtcgggaccgttcccgagnggtacttctcctggtgacgagcggttcgttgattccgtaacccttcgaagttagtcagttgcntcgcgtaacggtcggtacccgcgacggcctacgacggacgaggggcgtagggnggtggggtaggctaaggtaattcgaggtacngtaggtggtactagaactattacagtccggaaaccnggtaccgtacggtacgtaacggtacgtaccgtccgttaaccgtacctaccgtacgaagaacgtaaccaaaccgtacgtaaccgacgtacgtacgtacgtacgcgtaacgactacgaaccgtcgccgtagacgtaacgcgaacgggactacggctaaggttactacgtaatcgngtacgactaggaaccacgtactacgtacg

SEQ ID NO: 266062 - DNA, 798 bp, Homo sapiens
  misc_feature: GYAE6OF02FVQL9.34.26.C04.1.454.CMB.1.raw
  modified_base (170)..(170): a, c, t, g, unknown or other
  misc_feature (170)..(170): n is a, c, g, or t
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcgaccatcgggagttttgggactggagccgtgggtttttccncggttgccttacgtttttaaggcggttcgtcccgtaggttgtccagggttgaccgagtcgtggtggacgttcgnggggggtacgcggtggccccgagtcccgtgggaacctccgtagacggtactcgttccgtggngtacgacgtcgtcgtaggacctttcctaccgttcgaagggttactacctaggttccgggactaacggttcggaccgtaacggtttccggggacctacgaaccgggtccttaccggacgggaccgttaaggggcctttaggggagtttcgggggtaccgacttaggggttttaacacgggtagtttaaggtccggaagtttgggggtaaaacggtttacgttacaaacgggtttaccctagggttccggtaacacgggtttaccgttccggtaaacgggacggtaccgtagtacccgtaccgtaacccgtcgtaacgtaacgtaacccggtaactaaccccgtaaagaaccgttaccgacgtacgtagttacaaccgtactaacgaccgtacgtacgtaccgacgacggtacgacgggtcgaaccgcggtaacgttcggttactacggttaactcggtacgtagaacggacgtaagccgtaccggcgttacgg

SEQ ID NO: 266063 - DNA, 791 bp, Homo sapiens
  misc_feature: GYAE6OF02JD8JT.34.26.C04.1.454.CMB.1.raw
  modified_base (157)..(157): a, c, t, g, unknown or other
  misc_feature (157)..(157): n is a, c, g, or t
  modified_base (162)..(162): a, c, t, g, unknown or other
  misc_feature (162)..(162): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (347)..(347): a, c, t, g, unknown or other
  misc_feature (347)..(347): n is a, c, g, or t
tcagtacacgtgatcacgaccggtgctcgatttagtctagcgactttggtttggggctgggagaggagcccagcactagaggtcggcggtgttccattcggtgatcagcactgaacacagaggactcaccatggagtttggctgagctggttttccncgttncgtctttaagngtgtccagtgtcagggtncgagtcgtggtggagtcgtgggggagtcgtggcccagccgtcggaccgtccctagagtacctccgtcctgtagcagtcgtcgtaggtcttaccaccgttttacgagttaacggtcaaggttcggacctagttgacccgtacggttcggggtacccnccggtaaggcccttaaccggagggtaccgtaaacggggggtctagggtacgggtcgggggtacgtacgttagtttactagttacgggttatggacgtaagggtaagtcgttaataaccgttagtactagtacggtacgaccggttaccggtaacggaaccggtccgggtaactccccgttaacgtctaaccgaaagggttaccaaaaccgttaccgaaacccctaaacgggtaacctaccggtaaaccgttcgttaaaccgttcccgtaagtaaaccgttacgtacgtaaacccgtaggtaccggtacgtaaaccggaccggacccggaacgggacccggtttacgtaacggtttaacgtaccggtttaaactaccggggtttagtaccggggtaaccggtgggaaaccgaccgggttaaccacccggttaccgtaaacccggg

SEQ ID NO: 266064 - DNA, 665 bp, Homo sapiens
  misc_feature: GYAE6OF02H8SRO.34.26.C04.1.454.CMB.1.raw
  modified_base (159)..(159): a, c, t, g, unknown or other
  misc_feature (159)..(159): n is a, c, g, or t
  modified_base (167)..(167): a, c, t, g, unknown or other
  misc_feature (167)..(167): n is a, c, g, or t
  modified_base (193)..(193): a, c, t, g, unknown or other
  misc_feature (193)..(193): n is a, c, g, or t
  modified_base (261)..(261): a, c, t, g, unknown or other
  misc_feature (261)..(261): n is a, c, g, or t
  modified_base (268)..(268): a, c, t, g, unknown or other
  misc_feature (268)..(268): n is a, c, g, or t
  modified_base (351)..(351): a, c, t, g, unknown or other
  misc_feature (351)..(351): n is a, c, g, or t
  modified_base (475)..(475): a, c, t, g, unknown or other
  misc_feature (475)..(475): n is a, c, g, or t
  modified_base (525)..(525): a, c, t, g, unknown or other
  misc_feature (525)..(525): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctgggtttccngttgcttntttaagaggtgtccagtgtacaggtncagcgtggtcggtagtcgtgggggagcgtggcccaggccgtaggggacttcccaggacacgtctccgngtcgacnggcgttacgtggacttcctaccttgagtagtccagtgacctaagtgaccgacggttcgggcccgaccgacggtacctacccgnggggtaaccgaaggggtcgtggtacgggtggagtactaggttactaggtcggtatcggaagtacgtaagtcgactaataccgttgcgactaaggtcccgtagaggacggtcctatcgtacctcnccgaagataaccgtaacctacgaaacgtaacaccggtcttaacggtaacncgtaacaacgttaagaccgaacccgtagtaccggaaacgtcggaaacgaccgggaacggtttaccaccggtttaacctggttaaccgtttaagtaccgttaggacgccgaaaggtcgaacggaccgtacgacgtaaccgg

SEQ ID NO: 266065 - DNA, 787 bp, Homo sapiens
  misc_feature: GYAE6OF02ITLX1.34.26.C04.1.454.CMB.1.raw
  modified_base (145)..(145): a, c, t, g, unknown or other
  misc_feature (145)..(145): n is a, c, g, or t
tcagtacacgtgatcacgaccggtgctcgatttagtctagcgactttgggtttggggctgggagaggagcccagcactagaggtcggcggtgtttccattcggtgatcagcatgaacacagaggactcacatggagttgggctgngcttgggttttcctcgttgcttgttttaacgaggttcgtccagtgtcgaggtgcagtcgtgggtggaggtcgggtgggggacggcggtcggacccgaggtcccgtacggggacctcccgttggaacgtcctccgtccgtggtcgcgtacggccgttgtcggtacttcccttaccgttagtaacgttcgtactagtacggactaagtccgacgtacgggtccgggtcccgaccgtacggtcccgtacggagggtaccggggaaagggtcgtaggggtacgggtgggggtacgtacgttaagttaacgttagtcggtaagtacggtaaggtagtaaacggttagtaactaaacgttaagtccgtaaggtacccgtaaggtaccggtacggtaacgggaccggtacgtacttacggtaccgttacgacgtaagaaccgaacctaacgaacccaaacgaaccgtacgtacgtagtactacgtagaactacgacgtaacccgacgttacgtaaacgacggtaaccgacgggtaacgaccgggtaacgttacggttaacgtttaaccggttaacggttaacggtaccgggttaaccgaacggaacggaaccggtaaccggtaaccgaacccggtcccggtaaaccggg

SEQ ID NO: 266066 - DNA, 691 bp, Homo sapiens
  misc_feature: GYAE6OF02HSA0V.34.26.C04.1.454.CMB.1.raw
  modified_base (178)..(178): a, c, t, g, unknown or other
  misc_feature (178)..(178): n is a, c, g, or t
  modified_base (415)..(415): a, c, t, g, unknown or other
  misc_feature (415)..(415): n is a, c, g, or t
  modified_base (678)..(678): a, c, t, g, unknown or other
  misc_feature (678)..(678): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtctgggttttcctcgttgcttctttaagnggtgtccagtgtcgaggtgcagctggtggagtcgtgggggagcgtcggcccagccgtgggactcccgtgacgctctcctgtgcagcgtctggacttccgacctttcgagttagtcacgtggactatcggtcaccggttcgggtcccgccggacgggtccctaccggaacgggcggtaaggggccgttaggggacggttgggggtagggtactaggtttaaacgtggttagtttaggnggtaagttagggtaaagtacggtactaaactaacgtagtcgtacgtacgtaccgtaccgggttagggaacggtcccgtattacccgacccgtccgtacgagacgaacctaacgtaaccccgaaacgaaccgtccgctttaacggtccttacgtcgaaaccgtaaaagtcccgactacggtaccgtaggaccggaacgtaccggaacgacgtaccggcttaaaggtacgttacgtccgtaggcgacggtaagcggtaacaacgnggtacccctacgg

SEQ ID NO: 266067 - DNA, 961 bp, Homo sapiens
  misc_feature: GYAE6OF02GG4IK.34.26.C04.1.454.CMB.1.raw
  modified_base (385)..(385): a, c, t, g, unknown or other
  misc_feature (385)..(385): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagcgttgggtttttccctcggttgccttacttttaaggaggttcgtccgagtgtcgaggtgcgagcgtgggtggacgtcggtggggggaggtcgtcgggaccccaggcccggtggggtacccgtccccgtaggacgtaccttccgtccgtggtacgctacggcgttccgtaggtacttacctacccgtttcgaagttacgtcgaagttggcctaagtcgccgtacggttcgggcccnccgacggccctaccggacgggacggtacgggggtcgtgggagggttcggggtcggtaccgttaaggtttaactagggttagggttaacgtggaagggtttaacgggtaaaacggttacgttaaccgtaaaacgtttacgtaacggttacggtaaccctaaggggttaaccccggtaccgggttaacggggtaaacgggggtaccccggttaccggtttaccccggtaccccggttacccgtacccgtaaacggtaaccggttaaacctaaacccgttaaaccccggaaaccggtaaacccgttaaccgtaccgtttaacgttacccgttacgtaaacggtaaacccgtaaacggtaaccgtaccccggtaaacgggttacccgttaacgggaaccgggtaacccgggtaaccccgggtaaacgggtaccccgggtaaaccgggttaccgtttaaacgggtttaaccggtttaaaccgggtttaacccggttacgggttaacccgggaaccgggtaaacgggtaacccgggtaaaaccggttaccccggtaaccggttaacccccggttaacccggg

SEQ ID NO: 266068 - DNA, 753 bp, Homo sapiens
  misc_feature: GYAE6OF02I4JOF.34.26.C04.1.454.CMB.1.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (408)..(408): a, c, t, g, unknown or other
  misc_feature (408)..(408): n is a, c, g, or t
  modified_base (450)..(450): a, c, t, g, unknown or other
  misc_feature (450)..(450): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcttggtttccctgtgctacgttttaagnggtctcagtgtcaggtncagctggtgagtcgnggggacncgtcgcccaggccgtgggacctcctaggatacctcctcgtgcgacncgtctcgtgcttacctaccttgaagttcgtcagttcggactacgtggacctcggtccggtacccaacggtccggacttcccggaaggtacccggaaggggcctggggtaggttcggggtagattacggtaatttaggacggttaagnggtacgtagggtaaacttagtacgttaaactaacgtacggtnaacctaacggttacgtaacggtacggaaccgggtaaccgttaccttacccggtacccgttaccgtaaccgacgtaacccgaacgtaccggaaaccctaaacgaccgttaacgtcttacggtaaccgtcgtaaccgtaacgtaacctccggttaaccgaccggttaaccgtaacggtaaccggtaaaccgtaacccgggtaacgtacccggtaaccgtaacggttaacgttaacggttaacgttaccgggttaaccggacggacggttaacggaccgtaaccggcccgtaacggtaccctacgg

SEQ ID NO: 266069 - DNA, 790 bp, Homo sapiens
  misc_feature: GYAE6OF02FYYM7.34.26.C04.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (645)..(645): a, c, t, g, unknown or other
  misc_feature (645)..(645): n is a, c, g, or t
tcagtacacgtgatcacgaccggtgctcgatttagtctagcgactttgggtttggggctgggagaggagcccagcactagaggtcggcggtgtttccattcggtagatcagcactgaacacagaggactcaccatggagtttgggactgagcttgggttttcctcgttgcttcttttaagnggtntccagtgtcgaggtgcagctggtggagtcgtagggggagcgtacggccccagccgtacgggacctcccgtagacgaccttcttccgtggtcgccgagtccgttcgttaggtactttcccgaacccgtttactaacggttaggttccaagttcgggtacctaagttccgtaccgtaacccggttggggtaaccccccaaccggtccggttaccgtaccccggaaagggtcccggaaggggggtaccttgggggttacgggttaggggggtcggacttaagggttttaactagggttagggttaagtggttaacggtagggttaaactttacggtaactaaacgtttacgtagttacggaacctaacgggtacccgttacggtaacgggtaaccgggtaccgtaccgttacccgtacccgtaccgtaccgaacggtaacgaccgttaaacctacccggaaanaacccgtacgtacgttacgttaccgtacgtacgaaccgtaacgtacgaccgttacgactaacgacggtcgaccggtacgacgaccgtatacgtacgtttacgacgttacgcgtaagtacgacgaacggacctacgccgttaacgg

SEQ ID NO: 266070 - DNA, 756 bp, Homo sapiens
  misc_feature: GYAE6OF02FEXBU.34.26.C04.1.454.CMB.1.raw
  modified_base (161)..(161): a, c, t, g, unknown or other
  misc_feature (161)..(161): n is a, c, g, or t
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (376)..(376): a, c, t, g, unknown or other
  misc_feature (376)..(376): n is a, c, g, or t
tcagtacacgtgatcacgaccggtgctcgatttagtctagcgactttgggtttgggctgggagaggagcccagcactagaggtcggcggtgtttccattcggtgatcagcactgaacacagaggactcaccatggagtttgggctgagcttgggttttccncgttgcttcttttaagaggttntccagtgtcaggtncagctggtgagtcggtgggggagtcgtcgcccagccgtgggaccctccctagacgtaccttcgtccgtgtcgaccgtaggttccggtttggaactttccgtaacccgttgaacggtttacgtctaggtacggactacgttcgccgtaccggttaccggggtcccaccggtacggttccnccggaacgggtcggtaaaggggtctggggagggttcgggtacgtaacttaaggtttacgtaggttaacggttacaggtaggtttaacgggtaaaggtttaccgtaacaaagtttaaccgttaggacgaacgtacgtaccggtaccggtacggtaacggtaccgtacttaccgtaccgttaccgtacgtaaacgacgtaaccgtaacctaaccgaaactaaccgtacgtaccgtagtacgttacgacgtaacaacgttacgacgtacgtacgtaaggacgacggaccggtacgtaaccgtacggtaacgtagttaacgttacggttacgttcggacgtaacggaacgtacggaacgaccgtaccgaccgttacgtaccggg

SEQ ID NO: 266071 - DNA, 658 bp, Homo sapiens
  misc_feature: GYAE6OF02FSP5K.34.26.C04.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggcccagcctgggactcctgacgactctcctgtgcagcgtctggattcaccttcagtagtcatggcagtncacgtcgggtcccgccgaggcctaccgaggcgaaggggtctagggaggttggggtaggcgtaagttatagttgggtaattggattaggggtaagtagttacgaaagttacttagtggacctaacgggtaccttccgggtagggaaaccgggtccgtaacgttcccgtacccggttcgtacccgaaggacgaaaccgtaaaccgtaacccgaaacgaacccgaccgtacttaggtacttcgttacgtaacgtaaacgttacgaacccgtcgtacgtacgacgtacggacccggaggaccgtacggacgttaagttacgtaacttacgtggtcggtacgaacggtagaacgtacgaccggacctaacgg

SEQ ID NO: 266072 - DNA, 716 bp, Homo sapiens
  misc_feature: GYAE6OF02HK8CD.34.26.C04.1.454.CMB.1.raw
  modified_base (180)..(180): a, c, t, g, unknown or other
  misc_feature (180)..(180): n is a, c, g, or t
  modified_base (283)..(283): a, c, t, g, unknown or other
  misc_feature (283)..(283): n is a, c, g, or t
  modified_base (326)..(326): a, c, t, g, unknown or other
  misc_feature (326)..(326): n is a, c, g, or t
  modified_base (352)..(352): a, c, t, g, unknown or other
  misc_feature (352)..(352): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccagtggagtttgggctgagcttgggtttcctcgttgccttgtttaagnggtgtccagtgtcaggtgcagtcgtgggtggagtcggtgggggacgcggtcgacccagcccgttggggacctccgtaggacgaccttcgtccgtagtcgacgngtcgtctaggtactttccacgttcgagtagtcagtcggactgngactcggtcggtccgaccacggtccnccgaggacggaagggtcgtagggtcgggtggggtcgtacgttaggttatagggttgtactgggtaagttcgggtaaaagttcgtaacctaagttacctagtcggacgcgttaaccgtacgggtagggaaaccggtccgttaacgttacccgaaccgtccgtaacccgaaggtaaccggaacctaaccgtaacccgaaagtaaaccgtccgttactacgtaacgttacgacgtaacgtaaactccggaaacttaccgacgtaggacgaccgtaaccggacgtacggtacgtaccgttaagttaccggttactaccggtagtaccggaggtaacgacggttaccgacgtaccggttacccgaacgg

SEQ ID NO: 266073 - DNA, 778 bp, Homo sapiens
  misc_feature: GYAE6OF02IHM3P.34.26.C04.1.454.CMB.1.raw
  modified_base (234)..(234): a, c, t, g, unknown or other
  misc_feature (234)..(234): n is a, c, g, or t
  modified_base (314)..(314): a, c, t, g, unknown or other
  misc_feature (314)..(314): n is a, c, g, or t
  modified_base (618)..(618): a, c, t, g, unknown or other
  misc_feature (618)..(618): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgagcttgggttttcctcgttgcttcgttttaagaggtgtccagtgtcaggtgcagctggtggagtggtgggggaggcggtcggcccnggccgtgggaccgtccctggacgaccttctcctgtcgcaggcgtcgtggtacttcctacctttcagttagtcagtggacngttcgctacgtcgggtcccgcgacggcctccgaggaccggaaggggtcgtagggtagggttcggggttacgggtaccgttaaaagtttaaaacggaaccgtaaaaagtcggtaagtggggtaagggaaaaccaaaacggtacggtaaaccgtaccggtcgtaccgaaccgtaaccccgggtaaggtaaacggcgtaacgtaccgttaccgtaaccccgtacgtaaccgtaaaggtacgtaacgttacgtaaaaccgttaaaaccgaaaaaccgtacgtaaccggttagtaaactaaccgtaaanaaacgtaacgtaaacgaagtaacctaaagtaaccgtaaaacggaacgaaccgaacgtacgtacggttaagttacggttaaggttagggtagggtaacgtacgtaaggttacggttacgtttaaccgttacccgtaacgggtccgggtaccgtaacccggg

SEQ ID NO: 266074 - DNA, 773 bp, Homo sapiens
  misc_feature: GYAE6OF02FYVXK.34.26.C04.1.454.CMB.1.raw
  modified_base (380)..(380): a, c, t, g, unknown or other
  misc_feature (380)..(380): n is a, c, g, or t
  modified_base (638)..(638): a, c, t, g, unknown or other
  misc_feature (638)..(638): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttgggctgagcgttgggtttttcctcggttgtcttacgttttaagagggttcgtaccagttgtctaggtgcaggcgttgggtggagtcgtgggggaggcgtggcccgagccgtagggaccgtccgtaggacgtacttcttccgtggtgccaggtccgttacgtgggtaacttcctaacctttcgaaggttacggtaccgtaggttcgggctaagttcgacgtaacggtttcggggacccnccggaacgggtccctaacggaacgggtccggaaagggggtcgttaggggacggttagggggtacggtaccggtaaggttacttaaggttgggttaagtggtagttaaagggaaacggtttacgttaacgaaagtttaacttaggtaggaccgtaaggaacctttcggggaaaggtaaccgggtacgtaacgttaccgtacccggtacgttaccgaacggaacgaaccgtaacgttaaacccgaacgtaacaccggttntaacgtatgtacgaactacgtaacgaccgacgtacgtacggtaacggacgaaccggaacggacaaccggtacgttgtaacttacgtacggttacggtagacggtaacggagacgtaccgtacctaccggtaacgg

SEQ ID NO: 266075 - DNA, 589 bp, Homo sapiens
  misc_feature: GYAE6OF02JMTV2.34.26.C04.1.454.CMB.1.raw
  modified_base (324)..(324): a, c, t, g, unknown or other
  misc_feature (324)..(324): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (436)..(436): a, c, t, g, unknown or other
  misc_feature (436)..(436): n is a, c, g, or t
  modified_base (458)..(458): a, c, t, g, unknown or other
  misc_feature (458)..(458): n is a, c, g, or t
  modified_base (558)..(558): a, c, t, g, unknown or other
  misc_feature (558)..(558): n is a, c, g, or t
  modified_base (570)..(570): a, c, t, g, unknown or other
  misc_feature (570)..(570): n is a, c, g, or t
  modified_base (576)..(576): a, c, t, g, unknown or other
  misc_feature (576)..(576): n is a, c, g, or t
tcagtacacgtgatcacgaccggtgctcgatttagtctagcgactttgggtttggggtcgtgggagaggagcccagcactagaggtcggcggtgtttccattcggtgatcagcactgaacacagaggactcaccatggagtttgggctgagctgggttttcctcgttgcttcttttaagaggttgtccagtgtcaggtgcagctggtggagtcgtgggggagcgtggcccagccgtgggacgtccctggagactctccgtgtgcaggccgtctaggattccaccttcgagttagtcagtggctatcgactacgtcggggtcccnccgaggcctccagggcctaagggggctgggaggtgggtgctagttatagtggtangatggaattganaattatacgngacagtcctacggtagacgggctacttcgaccgtntccgagacgactacaccgaaanaaccgtcgtctcggtaatcgtaagtaacaaacggtaccgaccgaacgtcctaagggacgtacggtacccggaagacgacggtactaattcggtattacgngtacgagtaggnggtaanaccgactcctacg

SEQ ID NO: 266076 - DNA, 795 bp, Homo sapiens
  misc_feature: GYAE6OF02GX5PY.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgctcttttaagaggtgtccagtgtcaggtgcagcgtggtggagtcgtgggggagcgtggcccagccgtgggacctccctgacgactcctcctgtgcaggtcgtcgtaggtacttccaccttcgagtacgttccagtggctagtgccgtacggttccggggacccgtaccggacgggcccgttacccggaaggggtacccggaaacggggggtccgttagggggtacgggttcggggggttaccggaccgtttaaaggttttaacggttaaggttagggtttaacggtagttaaagggttaacgggtaaaacggttacggttaactaaaacgtttacggttagtacggaaccgttaaccggtaccgttaccggaacgggtaaaccggggacccgtttaacttaccccggtaacccgttacctaccgaaacggtaaacctaaacccgtaaaccgttaacccggaaaacgaaccgtaccgtacgttacgttactaccgtacggaaacctaacgtccgtaaccgacgtaccgtacggaacggaaccggtccggaaggtaccgtaggtaccgttaaggttacttacgtacgtcggacggaacggtagacgtacggaacgtaccgtaccgtacgg

SEQ ID NO: 266077 - DNA, 666 bp, Homo sapiens
  misc_feature: GYAE6OF02I2OHL.34.26.C04.1.454.CMB.1.raw
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
  modified_base (628)..(628): a, c, t, g, unknown or other
  misc_feature (628)..(628): n is a, c, g, or t
  modified_base (637)..(637): a, c, t, g, unknown or other
  misc_feature (637)..(637): n is a, c, g, or t
  modified_base (651)..(651): a, c, t, g, unknown or other
  misc_feature (651)..(651): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgttgggttttcctgttgctcttttaagaggtgtccagtgtcgaggtcgcagtcgtgggtggtacgtcggtgggggaggcggtcggcccagcccgtgggaccgtccctaggacgacgtctccgtagcgacgagtcggtctgggactttaccaccgtttcctaaggtaggttccagtcgggtaccagtcggaactccggttaccggggtccgaccgacggtccttcccgaagggaccgaacgggggccgttgggaacgggtgggttcggcctaaggttatacgtaggttagtgaagttcgaaagtcgtcaataacgtatcggctaacgactaccggtaggaacggtccgtaactcgtacccgtcgtaccgaagtacgacctaacgccaaacgtaccacgtacgtgtaactcganagtaaacgngaccgtacggtcaaggacgtacgaacggctaccgagtacgtaagtttgaccttacgngttaacggngtacggtaggaacnccgagtcccgtaagg

SEQ ID NO: 266078 - DNA, 673 bp, Homo sapiens
  misc_feature: GYAE6OF02H6TP6.34.26.C04.1.454.CMB.1.raw
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (173)..(173): a, c, t, g, unknown or other
  misc_feature (173)..(173): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagttggctgagctgggtttcncgttgcttntttaagngtgtccagtgtcgaggtgcgacgtcgtgggtcgaggttcggtggggggaggtccgttcgggacccctggtcccgtacgggggtaccttcccgttaggacgtaccttccgtccgtgtcgagtcgtccgttntacggtcttcctaacttcaaggtcttccaggttcggatagtcgacgaccggttgggccctacngggcctaccggnggtaccgagggtntagggtntcggtgacgttagtattggacgtnacgtagtacggnttaaccggtnaaatttcagtccgaagtacgtcctacggtagacggtccgtagtacctcgtacgcgtagacgtaacgtacgaaccgtaacgacgacgtacgtacgttactcgacgtaacgaacgtacgaacccgtacgtcgtacgacgtaacggcgttaaccgacggtacccgtgttaaccgtagttaccgtcgtaacgtacggacggaccggtagaaccggtacgtaccggccttaagg

SEQ ID NO: 266079 - DNA, 622 bp, Homo sapiens
  misc_feature: GYAE6OF02F77TI.34.26.C04.1.454.CMB.1.raw
  modified_base (329)..(329): a, c, t, g, unknown or other
  misc_feature (329)..(329): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagccgtgggaccgtccctgacgactcgtcctggtcgcagcgtcgtggtatttccgacctttcgagttacgtacagttcggacctatgccacgtcgggtacccnccgaggtcctaccgagggccgaagggggctagggaggttggggtgctaggttatacgtggtatgagtggaagttgtactaagttactagtcgcaagtccgtacgagggaacggccgtatcaccgtctaccgagacgactacgacccaagtaccacgtctacgtacgtcgtagtaaccgtaatacggaaccctacgtacgtaggaacgaccgaccgggtacgaccggtacggacgttaagtacggtttaacttcgtggtacgacggaagaacggacgaacgtaccgcctaacgg

SEQ ID NO: 266080 - DNA, 797 bp, Homo sapiens
  misc_feature: GYAE6OF02GB1M8.34.26.C04.1.454.CMB.1.raw
  modified_base (183)..(183): a, c, t, g, unknown or other
  misc_feature (183)..(183): n is a, c, g, or t
  modified_base (300)..(300): a, c, t, g, unknown or other
  misc_feature (300)..(300): n is a, c, g, or t
  modified_base (444)..(444): a, c, t, g, unknown or other
  misc_feature (444)..(444): n is a, c, g, or t
  modified_base (554)..(554): a, c, t, g, unknown or other
  misc_feature (554)..(554): n is a, c, g, or t
  modified_base (756)..(756): a, c, t, g, unknown or other
  misc_feature (756)..(756): n is a, c, g, or t
tcagtacacgtgatcacgaccggtgctcgatttagtctagcgactttgggtttggggctgggagaggagcccagcactagaggtcggcggtgttccattcggtgatcagcactgaacacagaggactcacagtggagtttgggctgacgtcgttggttttcctgttgtcttcgttttaaaggngggttcgtaccaaggttcgtacgtaagggtgacgtacggtcgttcggggtcgggagttcgggtagggggggaggtccggttacgggcccctaaggcccgtgggggaccctttcccgngaacgtaccttccgtccgttgggtacgaccgtaggtccggttacgtcggttaaccttacccgtaacctttacggtaagttaacttccgaagttcggacctaatccgtaaccggcggtttcgggaccccgtaccgacgggtaccncgggaacgggtcggtaaggggttcgtaggggtagggtcggggtccgaagtttaaggttaacgttgaaggttacgtaagttaggtaggaagttacgtataagtacgttcgngtaccgacgtaaccgtacgggtaggaccgggtactacgttccgtcccgtacgtaacgagtaccgacgtaaaccacgtaccaacggtccttacgtaactaggtaccctaggaacgtagaccgtcccgtacggaccttaagggaccgtaccggggaacgaccggtacgtacggttaacgtacggtttaacggttactcgggtanccgggttaagtaggaacggacttaccggaccgaacgtacgg

SEQ ID NO: 266081 - DNA, 732 bp, Homo sapiens
  misc_feature: GYAE6OF02H3Z3S.34.26.C04.1.454.CMB.1.raw
  modified_base (152)..(152): a, c, t, g, unknown or other
  misc_feature (152)..(152): n is a, c, g, or t
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (210)..(210): a, c, t, g, unknown or other
  misc_feature (210)..(210): n is a, c, g, or t
  modified_base (471)..(471): a, c, t, g, unknown or other
  misc_feature (471)..(471): n is a, c, g, or t
tcagtacacgtgatcacgaccggtgctcgatttagtctagcgactttgggtttgggctgggagaggagcccagcactagaggtcggcggtgtttcccattcggtgatcagtcactagaaccacagaggactcaccatggagtttggcttagngcttcgggttttcctacgttgcttcgttttaagnggttntccagtgtcgaggtcgacngcgttagggtcggagttcggtcgggggacggtcgtacgccgaggccgttcgggaccgtccctaggacgtaccttcctaccgtggcgcgacgtccgttcgtgactttaccaccttcaagtagttaccagttacgctagtcgaccgtacggttcggtcccgacgacggtcctaccggaggtacggtacgggacgttaggacggttcggggtacgactagttgtacgtagttcgagtaggtacggtaagtacgtacaaaccgtnttaagcgtaaccggtacgtaccgttaccgggtacggtaacggtacccgtacgttaccgtacccgttaaccgtacgaacgaaccgtaaccgtaaaccgtaacccgtaacgaaccgtaaccgtacgtacgtaaccgtggtaacctaaggtaacctacgttaacccgacgttaccggtaacgacgtaccgacggtaacgacggtacgtaacgtcgtatacgttaaggcgttacgagtacgacgtaaccgcgtaccgtactacgg

SEQ ID NO: 266082 - DNA, 730 bp, Homo sapiens
  misc_feature: GYAE6OF02HIKX1.34.26.C04.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (257)..(257): a, c, t, g, unknown or other
  misc_feature (257)..(257): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctgttgctcttttaagnggtgtccagtgtcaggtgcaggctggnggagtcgtgggggaggcgtcggccctagccgtgggacctcccgtgacgctctcgntggacagcgtctgacttctaccttcgagttagtcagtcggtacactgccgaccggttcgggttcccgaccgaaccgggctacccggacgggacggaaacggggggtcgtggggtagggtcgggggttggtacgtaaggtttaagtagtttggggtaagtaggacgttaagggtaagtaacgttactaaacgttatacgtcgacgtaacggtacgtaccgggtaggaacggtaccggttacgtcccgtaacccgttccgtaaccggtaaggtaccgaacctaacctaaccgaaaccggaaccgtaacgtccgtttaacggtcgtttaaccgacgtaactaaacggtaccgtaaccgacggtacccagggtaaaccggacggaacgggtaaccgaccggtacggtaccgttagttaacgttacttacggtacgtcggacggtaaggagtaaccgtaccgacggaacccgtaacgg

SEQ ID NO: 266083 - DNA, 713 bp, Homo sapiens
  misc_feature: GYAE6OF02I85C2.34.26.C04.1.454.CMB.1.raw
  modified_base (302)..(302): a, c, t, g, unknown or other
  misc_feature (302)..(302): n is a, c, g, or t
  modified_base (411)..(411): a, c, t, g, unknown or other
  misc_feature (411)..(411): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctgggtggagttcgtgggggagtcgtcggcccagtccgtggggaccttcccgtggacgtacctcctccgtgtcgcagtcgtctggacttccaccttcagttancagtggcagtgcctacgtcggggtcccgacgaggcctaccgagggtaccgaagggggtcctaggggagggttgggggacggtacttaaggtttacgtagtaggggttanaggtacgtaggtaaagttacgtataacgttataagcgacgtaacgtaccggtcggtaagggaaccgggtcgtaacgtttcccgaacccggttcctacggaggaacctaacgaacccttacgaaacgtaccaccgtgtacgtacttacgtagaaacctacgtaccgtaacgtcgtaccgtaagacggtaaccggtaaccggacggaccgtaccggtaccgttaggtttaacgttaccgtttaaccggtcggtaacggtacggaacggtagtaaacccggtaccgaccgtaccccggttaacgg

SEQ ID NO: 266084 - DNA, 801 bp, Homo sapiens
  misc_feature: GYAE6OF02FV1M4.34.26.C04.1.454.CMB.1.raw
  modified_base (290)..(290): a, c, t, g, unknown or other
  misc_feature (290)..(290): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagtcttgggttttcctcgttgcttacttttaagaggtgtccagttgtcaggtgcgagtcgtggtggagtcggtaggggggagtcgtcggaccccgagtccgtgggacctcccgtgacgtactcctcgtagtcgcgacgccggtntacggtacttccgtaccttcggagttacgtacgattacggcagttcgaaccgtcggtccggggtaccgccgtacggtcctaccggaggtaccggaacgggtcgtaggggttacgggttgggggtcgtaacttacggttttaacgagggttcggttagtacggttaacggtaagggttaaacggttagttaaaccaaacggtttactacggttacggacgtaaccgtaccggttacgtaacgggaacggtacccgttaacggttcccgttaaccggtacctaccgggaaacgtaacgtaaaccgtaacccggtaaccaacggtaaaccgtacggttaccgtaacggttacgtaccgtaacggaacccgttaagttaaccccgaacggtacctaccgtaaacggacgtaccggtaaccggtacgaaccgtacggtacggtaactttaggttacccgttaagggtaccggaggtaacgtagggtaaccgaccgtaccgacccggtaacctaagg

SEQ ID NO: 266085 - DNA, 747 bp, Homo sapiens
  misc_feature: GYAE6OF02JHM8H.34.26.C04.1.454.CMB.1.raw
  modified_base (160)..(160): a, c, t, g, unknown or other
  misc_feature (160)..(160): n is a, c, g, or t
  modified_base (195)..(195): a, c, t, g, unknown or other
  misc_feature (195)..(195): n is a, c, g, or t
  modified_base (256)..(256): a, c, t, g, unknown or other
  misc_feature (256)..(256): n is a, c, g, or t
tcagtacacgtgatcacgaccggtgctcgatttagtctagcgactttgggttggggctgggagaggagcccagcactagaggtcggcggtgtttccattcggtgatcagcactgaacacagaggactcaccatggagtttgggctgagctgggttttccncgttgcttcttttaagcggtgtccagtgtcaggtncagctggtggatcgtgggggagcgtggcccagcctgggacctcctgagctctccgtggacngctctggattcaccttcagtgtcagttggactagtcgactcgtcgggtcccggaccacgggcctaccggacgggaccgaaagggggtcctagggaggttcgggggttaggacgtacggtttaactggtagggttaataggtagtacggggtaaagtacgggttaaccaaagttaaccgttagtacgtaccggtaaggtaccgttacccgggttacggtaaacggggttacccggtaaccgtttaccgttaacccggttactacccgtaacggaacggtaaacctaacgttaccccgaaaacgtaaccggtaacccgtacgttacgttaaccttaccgtacgtaacgaaacgttacgtaaccgtaaccgcccgttaaggacgtaaccgggtaccggtaacggtacccgtaacgggtaccgttaacgtacggttaaacgttaaccgtcggttacggacggtaacgtacggaacgaacgacggtaccctaacgg

SEQ ID NO: 266086 - DNA, 788 bp, Homo sapiens
  misc_feature: GYAE6OF02IC5FN.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagtcgtgggtttttcctcggttgcttactttttaaaggagggttcgtcccgtaaggttcggttccgaaggggttcgccgaggtccgttggggttgggaaggttccggtggggggggacgcggtcgggcccaggtcccgtggggaccgttcccgtaggacgtactccgtccgttggacggactacggtccgtccgttaggtaactttccgtacccctttagaaccggttagttccggaaacttcggggacctaagttcgaccgttaaccggttaccgggggtcccctacggaacggtccctttaacccggaggtaaccgggacggggttacgttaggggtacgggttcgggggtaggtaccttaagggtttacgtaaggttggttagtacggtacggttagggtaaacgtagttacgaaattagttacgacggcgtacgacgtaccggtaggacggaccgtataccgtacgactcgaagacgtacaacacgaaacgtacagtcgtataccgtagactaactaacgtaccgaccacggttacgaacgaacggaccgacggacggtacgaaccggtagtacgttaacggtcctttaaggccgtaccggtagaacgttacgaacgtacgtacccgtactaccggg

SEQ ID NO: 266087 - DNA, 656 bp, Homo sapiens
  misc_feature: GYAE6OF02F4T94.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcacccatggagtttgggctgagcttgggttttcctcgttgcttcttttaagaggttgtccagtgtacgaggtgcagcgtgggtggtaggtcggtaggggggagtcggtcggccccaggccgtagggtaccgtcccgtgaacgactcctccgtgtgctaggcgttcgtggtattccaccttcgagtatcagtgctagtcgctacggtcggcccgccgacggtctaccgaggccggtaaggggcgttgggaggtggggtcgacgttagttaagtaggtggttaataggtaagttaggtaagttacgtaataacgttactaagtcgtcgtaacgtccgttacgggaaggtaccgggtacctaacgttccgacccgttcgaaccgtacgaacgtaaccgtaacctaacccgaataaaccgcgtaacgttactacgtctaacgaactacgtacgacacgcgtaagaccggtacgaccgagaccgtaagtcgttagtacttgtacgtagacgagagagaccgatacgcgtacgg

SEQ ID NO: 266088 - DNA, 137 bp, Homo sapiens
  misc_feature: GYAE6OF02FON13.34.26.C04.1.454.CMB.1.raw
  modified_base (117)..(137): a, c, t, g, unknown or other
  misc_feature (117)..(137): n is a, c, g, or t
tcagtacacgtgatcacgaccggtgctcgatttagtctagcgactttgggtttggggctgggagaggagcccagcactagaggtcggcggtgtttccattcggtgatcaggactagnnnnnnnnnnnnnnnnnnnnn

SEQ ID NO: 266089 - DNA, 727 bp, Homo sapiens
  misc_feature: GYAE6OF02JU5D6.34.26.C04.1.454.CMB.1.raw
  modified_base (105)..(105): a, c, t, g, unknown or other
  misc_feature (105)..(105): n is a, c, g, or t
  modified_base (182)..(182): a, c, t, g, unknown or other
  misc_feature (182)..(182): n is a, c, g, or t
  modified_base (195)..(195): a, c, t, g, unknown or other
  misc_feature (195)..(195): n is a, c, g, or t
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
  modified_base (481)..(481): a, c, t, g, unknown or other
  misc_feature (481)..(481): n is a, c, g, or t
tcagtacacgtgatcacgaccggtgctcgatttagtctagcgactttgggtttggggctgggagaggagcccagcactagaggtcggcggtgtttccattcggtnatcagcactgaacacagaggctcaccatggagtttgggctgagtcgtgggttttcctgttgcttcttttaagaggtntcagtgtcaggtncagtcgtggtggagtcggtgggggacggtcggtacggccccgagcccgtacggggtaccgtccctaggaccgtccttcccgtccgtaggtcncgtaacggtccgtcggtcggtaactttaccctacccgtttagaacgttacgtnaagttcggctagttgaccgtcgtcggtcccncggaagccctaggcgggaacggacggggcgtagggttagggtggggtgtactaaggtttaagtgggtaagttagagtaggttacggtaaacgtcgtataagttaagttanaccggttacacggtacccgttacgggtacgggaaccgtccttaacgttccgaacgttccgacgaaagtaccaaaccgtaaccgtaacccgtaaccgtacaacgttccgtagttcgtaccgacgtacaacgtacgaaccgtcgtacgtagacgtacgaaccggtaccgagttaccgtaacttagtacggttacttacggtcggtaccgaggtacggaaagtaccggaacttaccggacccttacggg

SEQ ID NO: 266090 - DNA, 710 bp, Homo sapiens
  misc_feature: GYAE6OF02GCE4W.34.26.C04.1.454.CMB.1.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (353)..(353): a, c, t, g, unknown or other
  misc_feature (353)..(353): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggctcaccatggagtttgggctgagcttgggttttcctgttgctcttttaagaggtgtccagtgtcaggtncagctggtggagtcgtgggggagcgtcggcccaggcctgggacctcccngagacctctctgtgcaggcgtctaggtacttccacctttnaagtgtacagtggctatcgacacgtcgggtcccncgaggcctccgaggccggagggcgtgggagtggggngacttagttactcgtaggtataggagttagggaacgtagttaaccaaagttaccgtagtcggaacctacgggtaccgttccgggtaaggtaacccggggtacccgttaacgtttacccgtaccccggttacgtaacccggtaaggaaccggtaaccctaaccggttaaccccggaaaactaaccgggtaccgttacgtacgtttaacgtccgttaagaaacccttaaggtacctaacccggtaccgtaacgtacggaacgtaccgacgggtaaccggacgtaccgtacgttaggttacgtttaacgttacgtcggtaaggaacggacggtaacggaccgacgtacgacccgtaacgg

SEQ ID NO: 266091 - DNA, 655 bp, Homo sapiens
  misc_feature: GYAE6OF02G18IN.34.26.C04.1.454.CMB.1.raw
  modified_base (274)..(274): a, c, t, g, unknown or other
  misc_feature (274)..(274): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
  modified_base (457)..(457): a, c, t, g, unknown or other
  misc_feature (457)..(457): n is a, c, g, or t
  modified_base (647)..(647): a, c, t, g, unknown or other
  misc_feature (647)..(647): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctggagtcgttgggttttcctcggttgcttattttaacggaggtctccgagttgtcgtagggtcgctagcgtgggtaggtgtcggtgggggagtcgtcggcccagccgtagggacctcccgagacgcttcnccgtgngacgngcgttcgtaggtcttaccgaccttnagtacgtcngtcgactagtcgacgtacggtcggttcccaccgacggttcacccggagggtacgaagggggtctaggggagggttcggggagtacttaggttactaagtggttagagtagtaaaggacgttaagacttaatacgtagngtacacgtacgtcgacgaggtactctacgacgtacgcgtaagacgaacaaccgacgaaacgaccacgagtctactctacggaacctaaggtccgaacccgtgtaaccgtaggacggtaaacgacccggagacccgcggttaacgttacgttagttaacctggttacgaggacgtaggaacacgacgtacnccgtaacg

SEQ ID NO: 266092 - DNA, 793 bp, Homo sapiens
  misc_feature: GYAE6OF02FXNLW.34.26.C04.1.454.CMB.1.raw
  modified_base (179)..(179): a, c, t, g, unknown or other
  misc_feature (179)..(179): n is a, c, g, or t
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagnggttgtccagtgtcaggtncagctggtggagtcgtgggggagcgtcggcccgagtcccgtggggaccgtccctaggaacgtaccttccgttccgtggtcgaccnggtccggttccgtgggtaactttcccgaaccgtttcgaaggtttacgtcgtaacgtgggtcctaagttcgaccgtaccggttacggggtcccgaccgtaccggggccttccccgaaggggaccggtaaacggggggtccgttgggggtaacggttcggggggtacggacctttaacggtttaaggttaagttcgggggttaattagggtaacgggttgggtaaaaggttacggttacctaaaaggtttaccgtttaagacggtacgtaacggtacccgttacggttagggtaacccgggggtaccgttacgttacccggtacccgttaccgttaccgaacggtaacgaaccctaaaccgttaacccgaaacgaaaccgaccgtcgtaagttaccgtctaacggaactaaacgtcgaaccacgtccgtagacggtggaccgaggaccgcggtactattacggtacgttacgtaggacgtacggagaccggtagaacgtccgaccgttacgg

SEQ ID NO: 266093 - DNA, 689 bp, Homo sapiens
  misc_feature: GYAE6OF02IGOXX.34.26.C04.1.454.CMB.1.raw
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagnggtntccagtgtcaggtgcagctggtggagtcgtgggggagcgtcggccagccgtgggctccctgacgacctctcctgtcgcagcgtcgtggacttcaccttcagttacgtcagtggcagttcgcctacggttcggggtcccaccgaggtcctaccggagggacgaagggggctagggaggtggggtcggctaggttactaggttaggtacgtaggagttacgggaagttaggtactaaattactaaggtcacgacgtacgtccggtagggaacgggtccgtacgttacccgtccgttaccgtaccgaggaaccgaacctaaccggaaccgtaaagaaccttaccgtaactttacttaacgtaaacgtaacgtaacgaaacccgtcgtaacggaagtaccgtacggacggtaaccgtaacgttacggtttatttacgtttacgtcggtacgacggtaacggaccgacccgaccccgtacgtaccttcgtacgttccgtacccggttacggg

SEQ ID NO: 266094 - DNA, 921 bp, Homo sapiens
  misc_feature: GYAE6OF02G1RYE.34.26.C04.1.454.CMB.1.raw
  modified_base (185)..(185): a, c, t, g, unknown or other
  misc_feature (185)..(185): n is a, c, g, or t
  modified_base (273)..(273): a, c, t, g, unknown or other
  misc_feature (273)..(273): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctgagcttggggttttcctcgtttgcttcgtttttaaagnggtcgtccgagtgtcgaggtgcgagcgtggtggtaggtcggtggggggaggtccggtcgggcccaggcccggttgggacccgttcccnggacgaccgttccttcccgtgtcgacgtaggtccgttcgtggttacttcctacccgtttcgaacggttacgtacgtgtacgggctagttcggtacccgaccgggtttccgggggcccccgccgtacgggtacccgtacccggaaggggggaccggtaacggggggtaccggtaggggtccggggttagggggggttcggtacgggttaaccggtttaaagttacgggtttaggggttaacgttaggggtaaagggtttaagggtaaaaccggtttaggtaaaacctaaacggttttaaccttaaggtccgggtaacccgtaaccgggttacccgggttaccggggtttaacggggaaccgggtaacccggtttaacgttccccgggttaacccggttacccgtaacccggtaaacggaaaccggtaaccccgtaaaccgttaaacccccggtaaaagaaacccgtaccggtaaccgtttacgttaccgtttacacgtaaaccgtaaacgacccgaaaccgttacccgaccgttaggaaccggaccgggaaccggtaccggaccgaaccgttagtcggttaacgttaaggttaccggtacgttacggaacgtaaggaccggtaaacgacccggtacgcccggtaaccgg

SEQ ID NO: 266095 - DNA, 865 bp, Homo sapiens
  misc_feature: GYAE6OF02HG1WV.34.26.C04.1.454.CMB.1.raw
  modified_base (177)..(177): a, c, t, g, unknown or other
  misc_feature (177)..(177): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagcgtggtggagtcgtggggggagccggtggcccagcccgtggggaccctccctggacgtacctcctccgtggtcgccaggtccgttccgtggtactttcccaccgtttcaggttacgctagtcggacctagttcgaccgtcggttcgggcccaccggtaggtccctaccggagggacccgtaaaggggggtccttagggggacggttacggggggttcggaccgttaaaaggtttacgttaaagggttcgggtttaagtgtaagggtttaagggtaaacccgttaagtaacccgttaaaagtaccgtttaggtacggtacccgtaaaccgggtaccggttccgggtaacggggtaaaccggtacccggttaaacgttcccgttaacccggttaccgttaaccggaaacgggtaaccgaaacccgtaaccgtaacccggaaacggtaaacccaccggttaaccgtacggttaaccgttacgttaacgggtaaacctaacggtacccgtaaaccggtacgtacccggttaacggaaacggtaacccgggtacccgggaaggtacccggtaaccggtaccggttaacgttaccggttaaacggtttacggtacggttaacggaccggtaagggaaaccggtaccggtaactacccggtaccgttaacccgg

SEQ ID NO: 266096 - DNA, 507 bp, Homo sapiens
  misc_feature: GYAE6OF02HJ4EW.34.26.C04.1.454.CMB.1.raw
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtgggcccagcctgggacgtccctgagactctcctgtgcagcgtctggattcaccttcagtagtcatggcatgcactgggtccgccaggctccgagggcaagggggctgggagtggggtggcaggttatatggtatgatggaagtagtcaatactatgnagactcgtgaagggccgattcaccgtctccagagacaatcccaagaacacgcngtactctgacaatgacacgcctagagagccgaggaccacggtacgtatgtattctgtagcgagagagacagccacg

SEQ ID NO: 266097 - DNA, 673 bp, Homo sapiens
  misc_feature: GYAE6OF02IN1EP.34.26.C04.1.454.CMB.1.raw
  modified_base (180)..(180): a, c, t, g, unknown or other
  misc_feature (180)..(180): n is a, c, g, or t
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (463)..(463): a, c, t, g, unknown or other
  misc_feature (463)..(463): n is a, c, g, or t
  modified_base (655)..(655): a, c, t, g, unknown or other
  misc_feature (655)..(655): n is a, c, g, or t
tcagtacacgtgatcacgaccggtgctcgatttagtctagcgactttgggtttggggctgggagaggagcccagcactagaggtcggcggtgtttccattccggtgatcagcactgaacacagaggactcaccatggtagtttgggctgagcgtgggttttcctcgttgctcttttaagnggtgtccaagtgtcagtgcagctggtggagtcgtggggacggngtgcccgagccgtgggacctccgtgacgacttcgttcccgngttacggcacggtcggtcctggtaacttccaaccttttcgaagtttacgtacgtacgtcggtacctgttcgacctaccgtcggggttacccggcccgtaagggcccttacccgacgggacggtaacggggtcgttacgggaggttcgggtacggcgtaagttcgtagtggtagtcgagttgggaaattggacttaaaanccgttaaagtccgaggtaccgttactaggtacggaacggtccgtacttaccgaccgttcaccgtagactacacgtaaccaagaccgaactcgacgtaacctgacgaactacacgtaacctcgaccgtggaacgtaagaccgtacgaccgagttaccgtacgtactagtttaacgcgttaggacgtaggtaanaccggcgacgttaccacg

SEQ ID NO: 266098 - DNA, 845 bp, Homo sapiens
  misc_feature: GYAE6OF02JIRFW.34.26.C04.1.454.CMB.1.raw
  modified_base (171)..(171): a, c, t, g, unknown or other
  misc_feature (171)..(171): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagctggtttctcgtgctgtttaagnggtgtcagtgtacgaggtgcagtcgtgggtggagttcggtgggggaggtcgcgggacccagggccgtggggaccgttcccgtaggacgcctccgtccgtggtcgccgtacggcgtccgttaggactttccgtaccgttccgtaaggttagttccgtaacggttcggactagttccgacgtacggtccgggtccgtccgaacggtccgccgaacgggtacgaacggggtcgacgggtcggttggggtacgggacgtagttacgtaggtggttaagtgtaacggtggtaaaagtcgtaataagttactagtacgtactacgtacgtaccggttaggaaccggtcgtacgtaccgtacccgtacgtaccgtacggtaactaaccgtaacccgtaccgtaaaacgtaaccgttacccgtaaccgttacggtaaccgtccgttaacgtaaaccgtaacccggttaccgaaaaccggtaccggttaccgtaacgggaaaccgttaaaccggggaaccccgggtaaccgggtaaccgttaacccggggtacgggtttaaaccgtttaaccgggttttaaacccgtttacgggttaaccgttacggggtaaaccgttaccgggggttaaaccggaaccccggtttaaaccggaaccccggttacccggggtttaaacccggg

SEQ ID NO: 266099 - DNA, 634 bp, Homo sapiens
  misc_feature: GYAE6OF02G3QFM.34.26.C04.1.454.CMB.1.raw
  modified_base (351)..(351): a, c, t, g, unknown or other
  misc_feature (351)..(351): n is a, c, g, or t
  modified_base (389)..(389): a, c, t, g, unknown or other
  misc_feature (389)..(389): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtcggagtctgggggagcttggcccaggccctgggactccctgacgactctcctgtgcagcgtctggattcaccttcacggtatcatggcatgcacgtggtccgcaggcctccgaaggccgaaggggcctggacgtgggtcggcagttanagtcggtatcgatagggaagttagtactaagtctagtnacgtaagtaccgtacggtagaaccgggacgatttccgaaccggttccaccgtaaggtaacgaacctaacgtacccgaaaggtaacccgacgaccttacggttacctcgtaggaccctaaagtaccgaaccgtacggcccgttaagacggaagtacccgggtaacgacccgaacgggtactcggttaacggtactttaaccgtggttaccgaggtacccgaggaccgacgaccgtacccgtaacgg

SEQ ID NO: 266100 - DNA, 624 bp, Homo sapiens
  misc_feature: GYAE6OF02IYOJ8.34.26.C04.1.454.CMB.1.raw
  modified_base (317)..(317): a, c, t, g, unknown or other
  misc_feature (317)..(317): n is a, c, g, or t
  modified_base (510)..(510): a, c, t, g, unknown or other
  misc_feature (510)..(510): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggacgtccctggacgtacctctcctgtcgcagccgtccggtattccaccttcagttatcagtggcatgaccacgtcgggtccnccgaggcctacgaggccgaggggctgggagtgggtgatagttatagtggtatgagtaggaagtagtacaatacgtatcgactacggtaccgttcggtaggaacgggtcccgtatttcccggaacccgtcctaccgaaggtaacgaacctaaccgttaccccgaaaagtaccacgtacgttacgtactccgtanaactaaagtccgaaccgcgtccgagaacgaacgaccgggaagtacccgacgtacttaggtacgttacttagaggtagaccggtaagacgtacgaccgacgtaccgtagtaacgg

SEQ ID NO: 266101 - DNA, 660 bp, Homo sapiens
  misc_feature: GYAE6OF02JC3Q1.34.26.C04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
  modified_base (398)..(398): a, c, t, g, unknown or other
  misc_feature (398)..(398): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtncagctggtggagtcgtgggggagcgtggcccagcctgggactcccngacgactcctctgtcgcagccgtcgattcaccttcagtgtcagtggcagtgctacgtcggggtcccncgaggcctaccgaggacgaagggggctagggacggttcgggtaggctaaggtttactagtgggtanggtaagtagggtaaagtcgttaanaacgttacttaagcgccgtaagtccgtacggtaggaacgggtctacttaccgaccgtcctacgacgactaaccgactaaccgtaacgaccacgtccttacgtactccgtagaacgtaacgtaccgaaccgtagacccgttaggaaccggcggtaaccggacgggtaaccgtaccggttactacggttaagtttaacgttaccggttaggttacggaaccggtaggaacggtacgaaccgtaccggtacccgtaccgtacggg

SEQ ID NO: 266102 - DNA, 888 bp, Homo sapiens
  misc_feature: GYAE6OF02IM28Q.34.26.C04.1.454.CMB.1.raw
  modified_base (180)..(180): a, c, t, g, unknown or other
  misc_feature (180)..(180): n is a, c, g, or t
  modified_base (199)..(199): a, c, t, g, unknown or other
  misc_feature (199)..(199): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttggctgagcgttgggttttcctcgttgcttcttttaaagnggtgtcctagtgtcaggtnccgagtcgtggtggaggttcggtggggggagcggtcggacccaggtccgtgggaccgttccccgtggacgtcctcctccgtgtcgcgtaggtcgtcgtcggtacttcctaccgtttcgagttaggtcagtcggctagtcgctaccggtcgggtacccgaccgacggtccctaccggaacgggtacggaagggggtccgtaggggtacgggttggggtacggtaccgttaaggttaacgttagggtacggttaagtacggtaagggtttaagggtaaaacggtttaagtaaaccgtaaaaccgtttacgtaacggttggaaaccgtttacgggtaacccggtttaccgggtaaacgggtaaacccgggtacccggtttacgtttaacccccgacccggttacccttaaccgggaaaccggtaaacccggtaaactaacccgtaaaccccggtaaaggaaaccctaccgggtacgttaccgtaaacttccgggtaaacgtaaaacccggttaactaaccccgggtacctaccgggttaaccgtacggggaaaccgtaaccgggaccggtaacgggtaacccgttcgggtttaacctaaggttttaaccgttaaccggttacccggttaacggtacggacgggtaaccgttaacggtaaacccggtacctaccgggttaacccctaccgggg

SEQ ID NO: 266103 - DNA, 829 bp, Homo sapiens
  misc_feature: GYAE6OF02H9QSN.34.26.C04.1.454.CMB.1.raw
tcagtacacgtgatcacgaccggtgctcgatttagtctagcgacttttgggtttgggcgtggagaggagcccagcactagaggtcggcggtgtttccattcggtgatcagcactgaacacagaggactcacagtggagtttgggctgagtcgttgggttttcctcggtttgcttacgttttaaggaggttcgtccgagtgtcaggtcgcgagcgttgggtaggacggttcggtgggggacggcgtcggccccaggtcccgttcgggacccgttcccgtagaaccgtccttccgttcccgtagtcgccgtacgtcgttcgtagtacctttcctaaccgtttcgaagttacgtacgagttcggactagtcgaccgtaccggttcggtccccgaccgaacggtcccaccggtaagggaccgggtaaacggggtccgtaggggacgggttcggggtacgggaactttaagtttaacgtaggtttagggtaacgtggtaaacggttaggtaaacggtttaacctacgttaaagttaaaccgttagaccggtaacgtaaaccggttaccgtaccggtaacgggtaaaccgggtaccttaacgttaccccgtaaccggttaccgacccggtaaacggaacgtaaaccctaacccgaaaccccgaaacgtaaaccgtacccgttacgtacgtaacgttccgtaaacgacgtaaaccgccgtaaaccgtcgtacgacggaacgtaccggaccgtaacgtacccggaacgtttacgtaacggttaacttcggtacgttacgaggaacccgaggaacgaaccgactacccggactaccgg

SEQ ID NO: 266104 - DNA, 843 bp, Homo sapiens
  misc_feature: GYAE6OF02GWYIJ.34.26.C04.1.454.CMB.1.raw
  modified_base (183)..(183): a, c, t, g, unknown or other
  misc_feature (183)..(183): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtntccagtgtcaggtgcagcgtggtggagtcgtgggggaggcgtcggcccagccgtgggaccgtcccgtagacgacctcctccgtggtgcagtccgtcgtggtacttccgaccctttcgagtagtccagtggacatcggctacgtcgggtcccgacgtacggtcctaccggagggtacgaacgggggtcgtagggtaccgggttgggggtacggtacgtaggtttaagttacggtaggtttagtaggtaacgttagggaaaagtttaaccggtacttaaaacggttaccttaagttaccggaccgttaaccgggtaacccggttaccgggtaaccggggtaaccggggtacccctaaacgtttccccggtaccccgtacgtttacccggaaacggttaaaccgaacccgttaaaaccctaaccccggtaaaacggtaaacccgtaacccggttacgtttaacccgggttaaccgttaaccgtacggttaaaacccgttaaacccgtaccggtaacccgtaaccgtaccgtaacgggtaacggaacccggtacccggggtaaacggtacccggtaacgttacggttaacgttaacggtttaacgttaccggtggtaacgggtacgtaacggaaggtaccggaaccgtaccggccttaaccggg

SEQ ID NO: 266105 - DNA, 835 bp, Homo sapiens
  misc_feature: GYAE6OF02HH3N4.34.26.C04.1.454.CMB.1.raw
  modified_base (301)..(301): a, c, t, g, unknown or other
  misc_feature (301)..(301): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggtagtttgggctggagcgttagggtttttcctcgttgcttactttttaaaggaggtgtccagtagtcaggtgcagctggtggagttcggtgggggagcggtgcccaggtccgtgggacctccgtgacgacctctcctgcgcagtcgtgtaggtacttccacctttnagttcgacatcggacatacggctacggtcggtcccgccgaggccgtaccgagggtacgacgggggtctagggacgggttgggcggtactaggtttactaggttacggtagtaggaagttacgggaaagttacgttaacgtaaagttaccttagtacggtaaacgtacgtaccggtttaccggaaggggtacccggtaaacgttccgttacccggtacccgttaccgtaaaccgaacgggtaaacttaaccccgttaaacccaacccggtaaaccgggtaaacccttaccggtaccccggtttaaagtttacccggttaccgtaaacgaaaacccggttaacgggacctaaacccggtccgggttaaccgttaacgggaaacccggaccggggttaaccccgttaaacggggacccgggtaacccggtttttacgtttaaacgggttccggtttaaacgtttcggggaaccgtttcggggaaacggtacgggttaacgaacccggtaaacccggttccgtaccccggttaaaggg

SEQ ID NO: 266106 - DNA, 835 bp, Homo sapiens
  misc_feature: GYAE6OF02ITQJI.34.26.C04.1.454.CMB.1.raw
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgtgggttttcctcgttgcttcgtttaagnggttgtccnggtgtcaggtgacagtcgtgggttaggagtcggtggggggacgcggtcggaccaggtccgtgggaccgtccgtagagcctcctccgtgtcggcaggtcctcgtggtactttccaaccgtttcgagttagtcgtgttcggcacgttcgactaccggttcgggtacccgccaggtcctaccggaagggcggaacgggggccgttaggggtacggttcgggggtcgacggttaaaggtttacgtaaggttcggggttaaagttgggtaagtttagggggaaacgtttaccggtttaacaaaagtttaccggtttaggacccggttaggaacccgggtaccgtttaccgggtaacgggtaaacgggtaccggttacgttaaccggttaccccttacggtaacccagggttaaccaaaccgttaaccgtaacccggaaaccgtaacggtaaccgtccgttaccgttaacgttacgttaaccgacgttaacgttaaccggaaccgtacgttacccggaaggtaacgggtaccggacccggaaagggtacccgtaccgggtaaccttaaggttaaccgtttacggtaaccggttacggtttcgggaaccgttaacgggagaaaccggttacccgtacggacccgttaaaccggg

SEQ ID NO: 266107 - DNA, 528 bp, Homo sapiens
  misc_feature: GYAE6OF02GK1Q2.34.26.C04.1.454.CMB.1.raw
  modified_base (177)..(177): a, c, t, g, unknown or other
  misc_feature (177)..(177): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtctgggggaggcgtggcccagcctggggacgtccctgagactctcctgtgcagcgtcnggattcacttnagtgtcatggcatgcacgtgggtccncaggccncaggcaaggggctggagtgggtcggctagttanagtggtatgatggaatgtcaattcatgcagactcgtagacggcatcaccgtcncgagacgacaatacccgaanacacgctagtatctagactaaactcgaaccagtaccgtagacgacgaccgaggaccgacggtacgtacgtagtaacttacgtgtagacggtagacggagaacgacgccgtacg

SEQ ID NO: 266108 - DNA, 773 bp, Homo sapiens
  misc_feature: GYAE6OF02IH577.34.26.C04.1.454.CMB.1.raw
  modified_base (407)..(407): a, c, t, g, unknown or other
  misc_feature (407)..(407): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcacatggagtttggctgagtctgggttttcctgttgcttacttttaagaggtcgtccagtgtcaggtgcagcgtggtggagtgtggggggacgcgtcggcccaggtcccgtaggggtaccgtcccgtaggacgtacctcctccgtgtcgacaggtcggttcgtaggtactttaccacccgtttcgaaggtacgtccagttacgggactagtcgaccgtaccggttccggggtaccccggcctaacgggtccctaacccgagggtaaccgggaacggggtntacggggtacggtgggggtaccgtacgttaaggtttacgtagggttggtaagtaggtaaggttaacgggtaacgttacgggttaacaaaacggtttagacgttacggaacgtacccggtaacgttacccgggtaggtaaacccggggtcccttaagttaccccgaccgttacctaccgtaaggaccgtaaactaaccgttaacccaagacgtacccgttaagtctacttaacgacgtaacgtaacgccgaaccgtacgtacgaccggtaaacggtccggaacggacgtaccggtccgtagttaacggtacgttactacggttacgtagggacgaagtaccggaacggtacaccggtaccgtaacgg

SEQ ID NO: 266109 - DNA, 853 bp, Homo sapiens
  misc_feature: GYAE6OF02JDZSB.34.26.C04.1.454.CMB.1.raw
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagcttgggttttcctgttgctcttttaagaggtntccagtgcaggtgcagctggtggagtcgtgggggagcgtcggcccagccgtgggacctcccnggagctcgtcctggtgccagcgtatggattcaccttcaagtacgtcagtcggactacgtggcctacgtcgggggtaccccaccggtacggggtccctaccggaacggggtaccgaacgggggggttcttaacgggggtacggggttaggggggttccgggaccgtttaagggtttaacgtttaccgttagggggtttaaactcggtaaacgttagggggaaaactttaccggggtaacttaaaaacgttccggttaaagtcggaccgtaacggttaaccgggtacccggtaaggggaaaccggggttcccgttaaaccgtttcccgaaccccgggtttccacccgggtaaaggtaaacccggacctaaaaccggttacccaaacgggtaaacccaccggttactacgttaacgttccgacgtaaaccgaaacggtacccggttacgaaccggtcctaaacggggtaccgtacgggaaccccgggtaaggtacccgggttacgggttaaccccgtttaaggggttaccctttaaggttcgggttaacggttaccgggaacgggaaacggttaacggaacccgggtaagaccccgggtaccttaacccggg

SEQ ID NO: 266110 - DNA, 817 bp, Homo sapiens
  misc_feature: GYAE6OF02I2KW6.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggtttcctcgttgcttacttttaagaggtgtccagtgtcaggtcgcagctggtggagtcggtagggggacgcgtcggcccgagccgtgggaccgtccgtgacgactcctcgtgtcgccgtacggcgtcgtggtaccttccgtaccttacggtagttaaccgtcgtagttcgggctacgtcgacgtaccggttccggggtcccgtaccggacggtcccgtacccggaagggtccgggtaaacgggggtccgtacggggtgggttaccggggggtccggtaacgtaggttttaacggttacgtagggggtttaacttcggggtaagggttaacgggttaacggtttaacgggtaaccttaaaggttaacgtacgttacgggtacccgtaacgggtaccccgtttaccggggtaaacgggtaaaccggggttaccgtaccggtttaacccgtacccggttaccggtaaccgtaaccgggttaaaaccgaacccgttaaaccggttaaaaccgtaaacccggtaaccgaccggttaccgtaggttaacccgttacggtaccggtaaccgtaaagtccgaaaccgtacgaccgttaacgggacgtacgaccggtacggaccgtagtacgttatacgttagtgttcgagtcgagacgacgcgactgtacg

SEQ ID NO: 266111 - DNA, 677 bp, Homo sapiens
  misc_feature: GYAE6OF02JHGEN.34.26.C04.1.454.CMB.1.raw
  modified_base (324)..(324): a, c, t, g, unknown or other
  misc_feature (324)..(324): n is a, c, g, or t
  modified_base (432)..(432): a, c, t, g, unknown or other
  misc_feature (432)..(432): n is a, c, g, or t
  modified_base (518)..(518): a, c, t, g, unknown or other
  misc_feature (518)..(518): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggtttcctgttgctactttaagaggtgtccagtgtcaggtgcagctggtaggagtcgtgggggacgcgtggccccagcctggggacctccctggagacctcctcctggtgccagctcgtaggacttccaacgttcaagtctacatggctagtcgacctacggtcgggtcccnccgtaggtccctccgaagggtccgaaggggtctagggaggttgggggtacgtcgtaagttagtagtaggtatcggtagtacgggaaattcggtactaaagttcctaancgacgtagaccgtccgtaggaccggtcgtacgttctaccgtcaaccgagtaacgaacctaacggtaccaaacgtaacccgaacgtntaacgtacgttccgaagttaccgaaacgttaccaacccgtaacgtcccgttaaaggaccggaacggaccgaacggtaccgtaacggttccgtaagttacgtttaacgtacgttacggtaccggaacggttaagacggtaacgaaccggtcaacccgtcg

SEQ ID NO: 266112 - DNA, 783 bp, Homo sapiens
  misc_feature: GYAE6OF02HR2IK.34.26.C04.1.454.CMB.1.raw
  modified_base (201)..(201): a, c, t, g, unknown or other
  misc_feature (201)..(201): n is a, c, g, or t
  modified_base (728)..(728): a, c, t, g, unknown or other
  misc_feature (728)..(728): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcacagtggtagtttgggctgagtcgttcggttttctcgttgcttactttaagaggtcgtccaggttgcaggtncagcgtgggtggagtcggtggggggaggtcggtggacccgagccggtagggtacccgtccgtaggaatccttccctccgtggtcgacgtccggcgttacgtcggtactttcccgtaacctttcgacgtacggttacaggtcggtagacgttcggaccgtccggttcgggtcccgaacggacgtcccgtaccggacgggaccggggaagggtcggtacgggtaggggtcggggtacgggaagtttaggttaacttagggttagggtaactggttaggaaagggtaaagttaaccggtaactaagttaaactagttcggaaccgtacggtacggttacccgagggtaacccggtcggttaaacctccgtaccgttaccgtacggaaacgaaccgtaaaccgtaaccgtaaaccgaaacccgaaacggtacctcgtaacggtttacttaccgaacgaacggttaaactccggaaacgtacccgacgggtacgaaaccggtaaggacccggaacgtaccggtagaccgttntacgttacgtataggaccgtaggacgtaaggaccgaacgttaccggacctaacgg

SEQ ID NO: 266113 - DNA, 861 bp, Homo sapiens
  misc_feature: GYAE6OF02GWW7B.34.26.C04.1.454.CMB.1.raw
  modified_base (201)..(201): a, c, t, g, unknown or other
  misc_feature (201)..(201): n is a, c, g, or t
  modified_base (248)..(248): a, c, t, g, unknown or other
  misc_feature (248)..(248): n is a, c, g, or t
  modified_base (806)..(806): a, c, t, g, unknown or other
  misc_feature (806)..(806): n is a, c, g, or t
tcagtacacgtgatcacgaccggtgctcgatttagtctagcgactttggggtttggggctgggagaggagcccagcactagaggtcggcggtgtttccattcggtgagtcagcactgaacacagaggactcacatggagtttggctgagcttgggttttcctcgttcgcttacttttaaggaggtgtccagtgtcgaggtncagcgtggtggagtcgtgggggagcgtcgccagccgtgggacctccngacgacttctcctggtcacgtagtccgttcgtaggtacttcctaaccgtttcaaggttacgtacctaggtacgggactaaggttcgtaaccgttacggtccggggtccgaccggtaacggtccgtaaccggagggtaacccggaaggggttcgacggggtaacggtttgggggacgtacgtttaaggttaagtacggttaaggggttacgtacggtaaacgggttaagggtaaacggttaccgttaacgtaaaaccgtttagtacggtacggaccttaacggggttacccgttaccggggtaacggtaaccggggttaaccgttacggtttaaccccggtaccggtttaccggaacgtaaccgggttaaacaaacctaacccggttaaacccgaaacgggttaaaccgaccgggtttacgtaaacggtttaacgttaccgggtaaaccaacgttaaacgtcccggaacgtaaccgttccggtaaaagggtaccgaaacgggacccggtaaaccggtacgtaaccgggtacttaacgggtttaacttacggttaaccgngggacgtaacgggttaacgacgtaaccggtaccgtacgggttaccctaaccgggg

SEQ ID NO: 266114 - DNA, 766 bp, Homo sapiens
  misc_feature: GYAE6OF02GFWZB.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttacctcgttgcttcgttttaagaggtgtccagtgtcaggtgcagcgtggtggagtcggtgggggacggcgtcggacccctaggccgtaggggaccgtcccgtaggacgtaccttcctccgtggtgcgaggtcgtcgtggtacttccgtaccgttacgagttacgtcagtcgactagtcgcgtacggtccgggtcccaccgacggtccgtacgacgggacggaacggggtcgtagggacgggtggggtcgtagtaagtttacgtagtacggtagtaggtagtacggtaaagttagtacgaaatttacgtgtaggaccgagtaccgttagggaacggacgggtaccgtaacgtttcccgaacccgttccgtaacggacgaacccgtaaacgaacccgtaaacccgaaacgaacccgaccgttacgttaaacgtacccttaacgtacgtaaaccgtaaccgtaacggaacccctaacggtccggaaagtaacccggaccggtaaccggaacgtacccgtaacggttcgtaaacggtttaccgtttaagttacccggtaacggtacgaacggttaaaccggacgaaccgaacggtacccgggtaccaaccgg

SEQ ID NO: 266115 - DNA, 934 bp, Homo sapiens
  misc_feature: GYAE6OF02IV1BQ.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggttgtccagtgtcaggtgcagctggtgagtcgtgggggagcgtgcccagccgtgggacctccctagacgtacctcttcctggtcgcagtccgttcgtggtactttccaaccctttgaagttacgtactagtggtacctagttcgacccgtaacggttcggggtacccccgtaccggaacggttccctacccggaacggggaaccggtaacggggggtcgttaggggtacgggttcgggggtaccgggacttttaaagggtttaacgtagggtttacgggtaattaggtaacggtttaagggtaaaagttaggttaaaacctaacgtttaactaacggttacgaacggtaacggtttaccccggtaaccgggttaggggaaacccggggttaccctttaaacggtttcccccgaacccgtttacccgaaaccgaacgggtaaacccgtaaacccgttaaacccggttaaaacccgaaaaccggttaaaccccgtaccggtttaacggttaacggtttaaaccgttacccgtaagaaaacccgttaaacgggtaccccgtaaacggttacccggtaacccgaagggggaaacccggtacccggggtaaaccccgggtaaaggggtaccccgtaaccggggtttaccttaaaggggttttaccgttaaacccgtttttaacggacccggggttaaccggtaacggaaacgggtaaccggtaaacccgggaaccctacccggggtaaccccttacggg

SEQ ID NO: 266116 - DNA, 661 bp, Homo sapiens
  misc_feature: GYAE6OF02HKGYS.34.26.C04.1.454.CMB.1.raw
  modified_base (176)..(176): a, c, t, g, unknown or other
  misc_feature (176)..(176): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
tcagtacacgtgatcacgaccggtgctcgatttagtctagcgactttgggtttggggctgggagaggagcccagcactagaggtcgcggtgtttccattcggtgatcagcactgaacacagaggactcaccatggagtttgggctgagcttgggtttcctcgttgcttctttaagnggtgtccagtgtcaggtgcagctggtggtagtcggtgggggagtccggtacggcccagcccgtgggacctcccgtagacgaccttcctccgtaggtgtccgagtccgtcgtaggtaacttccaccgtttacagttaacgtctaagtcggactaagtcgaccgtacggtcgggtacccgacgacggcctacggaggacgaaggggtctagggaggtcgggtgacgtagttactagnggtatgaacgttaggtaacgtttanaacgttaaataccgtagtcgaacgtacgtaccgtacggtaaggtacggaccgtacgtacccaccgtctaccgaagtaaccgaacaactaccgaagaccgactctacgaacttcgactaacgtaagacgccgtaacgcgaaggactaacgacggagtacgacggttacgacgttagtacgttacgtacggtgaacggaacggagtaaccgtacgactacgtaccgg

SEQ ID NO: 266117 - DNA, 855 bp, Homo sapiens
  misc_feature: GYAE6OF02J2L9N.34.26.C04.1.454.CMB.1.raw
  modified_base (379)..(379): a, c, t, g, unknown or other
  misc_feature (379)..(379): n is a, c, g, or t
tcagtacacgtgatcacgaccggtgctcgatttagtctagcgactttgggtttggggctgggagaggagcccagcactagaggtcggcggtgtttccagttcggtgatcagcactgaacacagaggactcacctatggtagtttgggctgagtcgttgggttttcctgttgtccttagttttaagaggttgtccctaggttcgtacgtaagggttcgccgtaggtccgttgggtcgggtagttcgggtagggggtacggtccggacggcccgtaggtcccgtcggggtaccttcccgtaggacgtacccgttcgttccgtggtacgcgtacggtcgttcgtggtacctttccgtaccttgaacgttcgtcgagtccggntacgtcgtacggtccggttccgggccctaccggtcggtaccgccgggtaaagggtaccgggtacgggtaggtaccggggtcgggtttaaggggcggttaaccgtttaaggttaacgtacgggttccggttaagtaaggttacggttaacgggtaaggttaacgaattaaaaccgggttacgtcggtaaacggtcgtaaacccgttcggtacggtaaccgggtacgtacgttacctaccgtaccgtcgtacgtaacgacgtactaaccgacgtaaacgtcgtacgtcgtacgtacgacgttaagaccttaaccggcccgtaaacgtcccgtaagggtaacccggacggtaccgggtacccggaaaccgggttacccggtacgtttaccgggttaacgtttactttaaccggttcgggtaccgtaacggttacggaaaaccggttgaaccccggacgttaccgtaacccggttacggg

SEQ ID NO: 266118 - DNA, 186 bp, Homo sapiens
  misc_feature: GYAE6OF02HDMN7.34.26.C04.1.454.CMB.1.raw
  modified_base (170)..(186): a, c, t, g, unknown or other
  misc_feature (170)..(186): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcgggctggcaaggcgcatagnnnnnnnnnnnnnnnnn

SEQ ID NO: 266119 - DNA, 790 bp, Homo sapiens
  misc_feature: GYAE6OF02GHF1R.34.26.C04.1.454.CMB.1.raw
tcagtacacgtgatcacgaccggtgctcgatttagtctagcgactttgggtttggggctggaagaggagcccagcactagaggtcggcggtgtttccattcggtgatcagcactgaacacgagaggactcaccatggagtttgggctgagcttgggttttcctcgttgcttcttttaaggaggtgtccagtgtcgaggtgcgaggtcgtgggtggaggtcggtggggggacggtcggtcgggcccctagcccgttggggaccgtccccgtaggaacgtaccttccttccgtggtcgccgaggcgttcgtggtactttcctaccttcgtaaggtacgtacagtcggactagtcgccgtacggttcggggtccccgaccgtacgggtcccgtaccggaacggggaccgggtaaagggggtcgtttagggggtaacggggttcgggggtacgggtaaccgttaaaggttttaacgtaaggttagggttaagtaggtaaaggtttagggtaaaagtttaaggtaactaaaagttacttagtacgacgaacgtaccgtaccggtaacgggaacgggtaccgtacgttaccgtaccgtaccgtaccgaacgaacgaacctaaccgtaacccgaaacgaacgtaccgtacgtacgttacttacgtacgtaactaacgtacgaaccgagtaccccccccccccccccgtagacgacgaccgacgacgaccgtacgttacgtacgttacgttacgttacgtacggtacggaggaaggaacgacgaccgtaccgtaaccg

SEQ ID NO: 266120 - DNA, 827 bp, Homo sapiens
  misc_feature: GYAE6OF02I99YG.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggacgtcaccatggagtttggctgagcttggtttcctcgttgtctacttttagaggtgtccgtagtgtcgtaggtgcgacgcgtggtggtaggtcggtgggggacgggcggtcggccgacggccggtcgggaccgtcccgtagacgacctaccgtccgtcggtaaaaaaaaaaaaaaacgtcgacgacggttcgtggtaacgttaccttaccgttacgtaacggttacgtacgtaagtcggtacgtacgttacggtacgtaaccggttccgggtcccggacccggtaaccggttacccgtacccggaacgggtacgggtaaccggggtaccggtagggtacgggttacgggggtacggtacggttaacggtttaagttaacggttagggttacgtaggttaagtaagggtaacggttaacgttaacgtaaacgttaaacgttaacgtacggtacgtaaccggttaaccgtccggtaaacgggaccggtaccggtaacccgtaccgtacccgttccgtacgtaaggaacccgtaacaccgttaaaccgtaaacgaacgtacgtcttagtcttaacgacgaaacgtaacgtaccgaacgtacccgtacgttacggacgaaccgggtaccgaacgtacgacgttacgtaacgtagttaccggttacgtcgtaggacgtaacgtacggaacgtacgacacccgttacg

SEQ ID NO: 266121 - DNA, 669 bp, Homo sapiens
  misc_feature: GYAE6OF02HEH5P.34.26.C04.1.454.CMB.1.raw
  modified_base (197)..(197): a, c, t, g, unknown or other
  misc_feature (197)..(197): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagctgggttttcctcgttgcttacttttaagaggtgtccagtgtcaggtncagctggtggagtcgtgggggagcgtcggcccaggccctggggaccttcccgtagacgtacctccgtccgtagtcgaccaggtccggttacgtggaacttcctaaccgtttcgaagttacgtctaagtcggactaagtcgacctacggtcgggcccgtccgaggtcctccgaaggggccaaaggggctagggaggtgggtcggactagttatagtcgtatggaagtacgaaagtatacgaaattctaagcgaacgtacgtccgtcggtaggaaccgggtcttaacgtcccgtacgttcaaccggagtaacaacctaaacccgtacgaaacgtactacgtacgttataccgtagtacgtaaaccaacgtcgaaccgtaccgcgtaaggaacggccgaacggacggtaacctggtaaccgtagtacgttactacggtagtacgacggtaaggactacggacttacgccctaagg

SEQ ID NO: 266122 - DNA, 819 bp, Homo sapiens
  misc_feature: GYAE6OF02GJ3FL.34.26.C04.1.454.CMB.1.raw
tcagtacacgtgatcacgaccggtgctcgatttagtctagcgactttgggtttggggctgggagaggagcccagcactagaggtcggcggtgtttccgattcggtgagtcagcactgaacacgagaggactcaccagtggagtttggctgagcttgggttttcctcgttgcttcgttttaaggaggttgtccgagttgtcaggtgacagctggtggagtcggtagggggagcgtggcccgaggccgtgggtacctcccgtaggacgacttaccgtccgtgttagcgacggccgttcgtaggtactttccgacctttacgaaggttacgtacgtacgtttcggggacctaagttcggacccgttaacgggttccggggtcccccggtacccgtaaacggggttccctttaaccccggaaaggggacccggtaaaagggggtccgtttagggggtaaaggggttttcggggggccgtaacccgtttaaaaggtttctttaaaccgggttacgggtttaatacgggttaacggtagggtaaaacccggtttattacgtaaaaccgtaccgttaagtccgggaagtaccgtaccgttacggtaacggtaacgggtaccgtaccgttaacccggtccgttaaccgaccgttaaggaaccacgtaaaccgaacccgaagtaaaccgacgtacgtagtacgtaccgttacgaacgttaaccgtacgaaccgtacgtaccggtacgaaccgtcggaaccggcgaccgtcgtaacgtacgttagtacgttgtacgtagacgtacgtagacgtacgacgtacgtaacgg

SEQ ID NO: 266123 - DNA, 826 bp, Homo sapiens
  misc_feature: GYAE6OF02I51F4.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccagtggagtttggctgagcttggggttttcctcgttgtccttacgttttaaaggaggttcgtccgtagtgtcagggtgacaggtcgtagggtggacgttcggtaggggggacgtcggtcggtcccgaggtccgtcggggacctcccgtaggacgtccttctaccgttggtcacgaggtccgttcggtaggtacttccctaaccgtttcggaacggttacgtacctgttaccggacttacggtcggtaacccgtcggggttcccgggccctaccgacgggtcccttaacgggaccgggaacgtaaccgggggtctacggggtacggtacgggggtcgtaccgtaagtttaacttaggggttaggtagttacggtagggttaaacgtaacgttacgttaactaaacggtaccgtaagttacggaacggtaaccggttccggtacgggtaacgggtaacggtaccgttacgtttacccgaccggttaccgtaacgaacggtactaaccgaacgtaacccgtaagtacccgacgttcgtaaccgtacgtccgtaagtaaccgtacgtaccgaaaccgtcgtaacccgtaggaaaccggtacgtaacccggacggacccgtacggtaccgtttaacggacgttacggtcgtaacggtccgaacggtacgaaccggtacaacgggtaccctcggttaacgg

SEQ ID NO: 266124 - DNA, 796 bp, Homo sapiens
  misc_feature: GYAE6OF02HZFEJ.34.26.C04.1.454.CMB.1.raw
  modified_base (630)..(630): a, c, t, g, unknown or other
  misc_feature (630)..(630): n is a, c, g, or t
tcagtacacgtgatcacgaccggtgctcgatttagtctagcgactttggggtttggggctgggagaggagcccagcactagagggtcggcggtgtttccattcggtgattcagcactgaacacagaggactcacccattgggagtttgggctggagtcgtttgggtttttcccttggttgtacctttcgtttttaaaggaggttcgtccgtaggttgtcgtagggtgctaggtcgttgggtaggtagttcggttgggggacggtcggttcgggcccgaaggtccccggttcgggacccgttcccgtggaacgtaccttccgtccgtgtcggactacggtccgttacgtcggtaactttacccacccttttacgaaggttacgtactacgttacgggtactaacgttcggaaccgttcggtcggggtccccgacgacgggtcctaccggacgggacgtacggggtctaggggtacggtggggacggtacttaggttataggtggtagtacgagtaacggtagtagtaactaacgtactacggtactacgaacggtaccgtcgggtaaggtaaccgggtccttaacgtaccaccgttcgaccgagaccgaactaaaccgaaccaagtaaccncggttactagtaacgttccgtaacggaaccttaaagcccgaacctacggacggttagaaccgggaccggtaaccgggaaccgtaccggtggtaacctaggtttacgttaacgtcgggttctacgggagggttaacggtaggaaccaacggtccgtacccgtaacgg

SEQ ID NO: 266125 - DNA, 564 bp, Homo sapiens
  misc_feature: GYAE6OF02IXJ64.34.26.C04.1.454.CMB.1.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (447)..(447): a, c, t, g, unknown or other
  misc_feature (447)..(447): n is a, c, g, or t
tcagtacacgtgatcacgaccggtgctcgatttagtctagcgactttgggtttgggggctgggagaggagcccagcactagaggtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggcccagccgtgggactccctgacgactctcctgtgcagcgtctggatttccaccttcagtacgtcatggcagtgcgtacgtcgggtccnccgaggcctccgagggcgaaggggctgggagtgggngcagttatgnggtangagtagaagtctanaatacagtgctacgactacgaggacggcgattcgaccgtactaccgagtaacgacctaactaccgaaanaaccgacgacttacgtactcgtcgactaacgtacgaccacgcctagacggacgaccgaggacgacgtcgttatacgttagttacgtgtggacgaggacgaagaccgtacgcctaacg

SEQ ID NO: 266126 - DNA, 682 bp, Homo sapiens
  misc_feature: GYAE6OF02GWE1C.34.26.C04.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (480)..(480): a, c, t, g, unknown or other
  misc_feature (480)..(480): n is a, c, g, or t
  modified_base (534)..(534): a, c, t, g, unknown or other
  misc_feature (534)..(534): n is a, c, g, or t
tcagtacacgtgatcacgaccggtgctcgatttagtctagcgactttgggtttggggctgggagaggagcccagcactagaggtcggcggtgtttccattcggtgatcagcactgaacacagagactcaccatggagtttgggctgagctgggttttcctcgttgcttcttttaagaggtntccagtgtcaggtncagctgggtggagtcgtgggggagcggtgcccagccgtgggacgtccctgagacctctccgtgtcgcagtcgtcnggtattcctaccttnaggttactacatcggcaatcgcacggtcggtcccgaccaggtcctaccgagggaccggaaggggctagggtagggtcggggtaggcgtaagttacgtagtaggtataggtagtacggaaagtgtaactaaagttactagttgacgtagaccgtaccggtagggaacggtaccgtagtccgtacctccgtacgaanaaccgaactaaaccgtacccgtaaagaacccgtacggtacttacgtattaccgngtaaaccgtaagtaccgaacgtacgtaccgtaggaaacggaccggacccggaaggttaccgaccgggttactaacggtttacgtttaaccgttacgttaggtaacggtacgaacggttaaggacggaaacccaggtacccctaacggg

SEQ ID NO: 266127 - DNA, 704 bp, Homo sapiens
  misc_feature: GYAE6OF02GXAVQ.34.26.C04.1.454.CMB.1.raw
  modified_base (261)..(261): a, c, t, g, unknown or other
  misc_feature (261)..(261): n is a, c, g, or t
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggtgtccagtgtcaggtgcagctggtggagtcgtgggtgaggcgtggcccagccgtgggacgtccctgacgactctcctgtncgagcgtctggattcgaccttcagtacgtcatggacatgcacgtcgggtcccgccacggctccgagggcgaacgggggtctacgggtaggtggggttgggaccgtaggtttaacgtagtggtagttaggtagttgggtaaagttagtacgtaaattacgttacgtgtacgagtaccgtaccggtaggtaaaccggggacccgttaacgtttcccgaccgtacccgttacccgtaaggtaaccggaaaccttaaccgtaaaccccaaaacgtaaccctaaccggtcgttaacgttacttaccgtacgtaaaccgaaacctacggtacccgaacgttaccccgagggtaaccggaacgacccggacggtaacggacccggtacgttagtacgtttaacgttacgtttagtacggacgggaagtggaaccgtacggaccggtaacc

SEQ ID NO: 266128 - DNA, 733 bp, Homo sapiens
  misc_feature: GYAE6OF02FR554.34.26.C04.1.454.CMB.1.raw
tcagtacacgtgatcacgaccggtgctcgatttagtctagcgactttgggtttggggctgggagaggagcccagcactagaggtcggcggtgtttccattcggtgatcagcactgaacacagaggactcaccatggagtttgggctgagcttgggttttcctcgttgcttcttttaagaggttgtccagtgtcaggtgcagtcgtgggtggagtcgtggggggagcggtcggccccaggcccgtggggaccgtcccctaggacgtacttctccgtggtcgcgaggtcgttccgtgggtaatttccgacctttagacgttaggtcaggtcggctaagttcgctacggtcggggtccaccgtacggcctaccgaggtccgaaaggggtctggggtaggtttcggggggcgactaggtttaacgttaggtagggtttaacgtggtaatttcggggaaagttacggtaaacctaaaattcggttaatcgggtaccaaaggttcccggttccggtagggaaccgggtaccgttaacggttacccgtaccggttaccgtacccgtaacgacggtaaccgttaacgacccggaaacgaaccgaccggtactagttaccgtactacggtaactaacgtacggacccgtagtaccgtagacggacggtaccgacggacgaccggtctaacggttagttaacttcgtacgtagacggtagaaccgagaacgtacggctaaccg

SEQ ID NO: 266129 - DNA, 213 bp, Homo sapiens
  misc_feature: GYAE6OF01BKKUV.44.80.H03.1.454.CMB.1.raw
  modified_base (212)..(213): a, c, t, g, unknown or other
  misc_feature (212)..(213): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnn

SEQ ID NO: 266130 - DNA, 211 bp, Homo sapiens
  misc_feature: GYAE6OF01AEAU3.44.80.H03.1.454.CMB.1.raw
  modified_base (210)..(211): a, c, t, g, unknown or other
  misc_feature (210)..(211): n is a, c, g, or t
tcagacagtatatacacgaccggtgctcgatttagctgtgcgtcgaagggaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnn

SEQ ID NO: 266131 - DNA, 215 bp, Homo sapiens
  misc_feature: GYAE6OF01AWXJQ.44.80.H03.1.454.CMB.1.raw
  modified_base (212)..(215): a, c, t, g, unknown or other
  misc_feature (212)..(215): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 266132 - DNA, 213 bp, Homo sapiens; identical to SEQ ID NO: 266129
  misc_feature: GYAE6OF01D2U4S.44.80.H03.1.454.CMB.1.raw
  modified_base (212)..(213): a, c, t, g, unknown or other
  misc_feature (212)..(213): n is a, c, g, or t

SEQ ID NO: 266133 - DNA, 214 bp, Homo sapiens
  misc_feature: GYAE6OF01CHIK1.44.80.H03.1.454.CMB.1.raw
  modified_base (212)..(214): a, c, t, g, unknown or other
  misc_feature (212)..(214): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnn

SEQ ID NO: 266134 - DNA, 214 bp, Homo sapiens
  misc_feature: GYAE6OF01DML60.44.80.H03.1.454.CMB.1.raw
  modified_base (212)..(214): a, c, t, g, unknown or other
  misc_feature (212)..(214): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 266135 - DNA, 215 bp, Homo sapiens
  misc_feature: GYAE6OF01DHFZV.44.80.H03.1.454.CMB.1.raw
  modified_base (212)..(215): a, c, t, g, unknown or other
  misc_feature (212)..(215): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnn

SEQ ID NO: 266136 - DNA, 607 bp, Homo sapiens
  misc_feature: GYAE6OF01CJAB2.44.80.H03.1.454.CMB.1.raw
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(570): a, c, t, g, unknown or other
  misc_feature (569)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (582)..(607): a, c, t, g, unknown or other
  misc_feature (582)..(607): n is a, c, g, or t
tcagacagtatatacacgaccggtgctcgatttagctgtgcgtcgaaagggaaagggactggagtggattgggcgcatctataacagtggcagcaccaactaccaaccccgccctcaagagtcgagtcaccatgtcactagacaggtccaagaaccagttctccctagaaattgacttctgtgaccgccgcggacacggccgtatattattgtgcgagagtattcctatcgatacagtagaggacggggggcaacgtggctccggacccgtggggaccgaacgggtaccctggtcctaccgttcctcctcgacgccctcccaaccgaacgggccccacgttccggtcccttcccccgtcggccctacccctcctaccaaacgaccgacctacccgtcggtcgggggcctaaccggaccggcccgggtacccgtcggggaccttcggtccccggttacgggtaaccgaaccggtaacctttacctttaccgttaactttacttacgtgttccgtacggtacgggccgggtacgtcgggacgtaacgggccgacgtaagtacgntcngngnncngngtcngacnnnnnnnnnnnnnnnnnnnnnnnnnn

SEQ ID NO: 266137 - DNA, 213 bp, Homo sapiens
  misc_feature: GYAE6OF02HKXSR.44.80.H03.1.454.CMB.1.raw
  modified_base (211)..(213): a, c, t, g, unknown or other
  misc_feature (211)..(213): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 266138 - DNA, 215 bp, Homo sapiens
  misc_feature: GYAE6OF02I4537.44.80.H03.1.454.CMB.1.raw
  modified_base (211)..(215): a, c, t, g, unknown or other
  misc_feature (211)..(215): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnnn

SEQ ID NO: 266139 - DNA, 213 bp, Homo sapiens; identical to SEQ ID NO: 266137
  misc_feature: GYAE6OF02HLR3Z.44.80.H03.1.454.CMB.1.raw
  modified_base (211)..(213): a, c, t, g, unknown or other
  misc_feature (211)..(213): n is a, c, g, or t

SEQ ID NO: 266140 - DNA, 226 bp, Homo sapiens
  misc_feature: GYAE6OF02H6F3R.44.80.H03.1.454.CMB.1.raw
  modified_base (210)..(226): a, c, t, g, unknown or other
  misc_feature (210)..(226): n is a, c, g, or t
tcagacagtatatacacgaccggtgctcgatttagctgtgcgtcgaagggaaagggaccacggtcaccgtctcctcagcttccaccaaggcccatcggtcttcccctggcgccctgctccaggagcaccttctggggcacagcggccctgggctgcctggtccaaggactacttccgtctactgctgagcgggctggcaaggcgcatagnnnnnnnnnnnnnnnnn

SEQ ID NO: 266141 - DNA, 441 bp, Homo sapiens
  misc_feature: GYAE6OF02FY7KA.44.80.H03.1.454.CMB.1.raw
  modified_base (433)..(441): a, c, t, g, unknown or other
  misc_feature (433)..(441): n is a, c, g, or t
tcagacagtatatacacgaccggtgctcgatttagctgtgcgtcgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcggacccctggggccagggaaccctggtcaccggtctcctcagcctccaccaaggcccatcggtcttccccctggccaccctcctccaagacgcacctctggggcacagcggccctgggctcgctggtcaaggctacttcctatatactgtctgagcgggctggcaaggcgcatagnnnnnnnnn

SEQ ID NO: 266142 - DNA, 215 bp, Homo sapiens; identical to SEQ ID NO: 266135
  misc_feature: GYAE6OF02GAABO.44.80.H03.1.454.CMB.1.raw
  modified_base (212)..(215): a, c, t, g, unknown or other
  misc_feature (212)..(215): n is a, c, g, or t

SEQ ID NO: 266143 - DNA, 244 bp, Homo sapiens
  misc_feature: GYAE6OF02HGL30.44.80.H03.1.454.CMB.1.raw
  modified_base (213)..(244): a, c, t, g, unknown or other
  misc_feature (213)..(244): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagcnnnnnnnnnnnnnnnnnnnnnnnnnnnnnnnn

SEQ ID NO: 266144 - DNA, 216 bp, Homo sapiens
  misc_feature: GYAE6OF02GN4PF.44.80.H03.1.454.CMB.1.raw
  modified_base (211)..(216): a, c, t, g, unknown or other
  misc_feature (211)..(216): n is a, c, g, or t
tcagacagtatatacacgaccggtgctcgatttagctgtgcgtcgaagggaaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnnnnn

SEQ ID NO: 266145 - DNA, 259 bp, Homo sapiens
  misc_feature: GYAE6OF02JL17L.44.80.H03.1.454.CMB.1.raw
  modified_base (133)..(133): a, c, t, g, unknown or other
  misc_feature (133)..(133): n is a, c, g, or t
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (223)..(259): a, c, t, g, unknown or other
  misc_feature (223)..(259): n is a, c, g, or t
tcagacagtatatacacgaccggtgctcgatttagctgtgcgtcgaagggaagggaccacggtcaccgtctcctcagcttccaccaagggcccatcggtcttccccctggcgccctgctccaggcgcacctcnggggcacaggcgtcccgtgggntgcctggtacaacgggtctaccgtctaatcggtctgtctggaagccggtntaggcaggccgtnagngnnnnnnnnnnnnnnnnnnnnnnnnnnnnnnnnnnnnn

SEQ ID NO: 266146 - DNA, 517 bp, Homo sapiens
  misc_feature: GYAE6OF02I2T1H.44.80.H03.1.454.CMB.1.raw
  modified_base (491)..(492): a, c, t, g, unknown or other
  misc_feature (491)..(492): n is a, c, g, or t
  modified_base (494)..(517): a, c, t, g, unknown or other
  misc_feature (494)..(517): n is a, c, g, or t
tcagacagtatatacacgaccggtgctcgatttagctgtgcgtcgaaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcgaactggctcgaccccgtggggccagggaccctggtccaccgtctcctcagccctccaccgaacgggccccatccggttccgttcccccgtcggccacccctccctaccaagacgccacctcgtcgggggcaccgacggccggcccgtgggcctcggccgtacggtacgaacggtacctaccttcctaatactacgttgtctcggacggccggggctcgggacgaacgggcgacgagtagnncnnnnnnnnnnnnnnnnnnnnnnnn

SEQ ID NO: 266147 - DNA, 115 bp, Homo sapiens
  misc_feature: GYAE6OF01DIHAA.51.58.F03.1.454.CMB.1.raw
  modified_base (115)..(115): a, c, t, g, unknown or other
  misc_feature (115)..(115): n is a, c, g, or t
tcagcgatcgtatacacgaccggtgctcgatttagtctgatcgagaaggaaggcagcgtcactctgttcccgcctcctctcgtagcactctgagcgggctggcaaggcgcatagn

SEQ ID NO: 266148 - DNA, 126 bp, Homo sapiens
  misc_feature: GYAE6OF01DB47H.51.58.F03.1.454.CMB.1.raw
  modified_base (113)..(113): a, c, t, g, unknown or other
  misc_feature (113)..(113): n is a, c, g, or t
  modified_base (119)..(126): a, c, t, g, unknown or other
  misc_feature (119)..(126): n is a, c, g, or t
tcagcgatcgtatacacgaccggtgctcgatttagtctgatcgagaagggaaagggcagcgtcactctgttcccgccctcctctcgtagcactctgagcgggctggcaaggcncatagnnnnnnnn

SEQ ID NO: 266149 - DNA, 119 bp, Homo sapiens
  misc_feature: GYAE6OF01B12JF.51.58.F03.1.454.CMB.1.raw
  modified_base (119)..(119): a, c, t, g, unknown or other
  misc_feature (119)..(119): n is a, c, g, or t
tcagcgatcgtatacacgaccggtgctcgatttagtctgatcgagaagggaaagggcagcgtcactctgttcccaccctcctctcgtagcactctgagcgggctggcaaggcgcatagn

SEQ ID NO: 266150 - DNA, 119 bp, Homo sapiens; identical to SEQ ID NO: 266149
  misc_feature: GYAE6OF02G08MS.51.58.F03.1.454.CMB.1.raw
  modified_base (119)..(119): a, c, t, g, unknown or other
  misc_feature (119)..(119): n is a, c, g, or t

SEQ ID NO: 266151 - DNA, 142 bp, Homo sapiens
  misc_feature: GYAE6OF02I1HZH.51.58.F03.1.454.CMB.1.raw
  modified_base (118)..(142): a, c, t, g, unknown or other
  misc_feature (118)..(142): n is a, c, g, or t
tcagcgatcgtatacacgaccggtgctcgatttagtctgatcgagaagggaaaggcagcgtcactctgttcccaccctcctctcgtagcactctgagcgggctggcaaggcgcatagnnnnnnnnnnnnnnnnnnnnnnnnn

SEQ ID NO: 266152 - DNA, 119 bp, Homo sapiens
  misc_feature: GYAE6OF02IHTRW.51.58.F03.1.454.CMB.1.raw
  modified_base (119)..(119): a, c, t, g, unknown or other
  misc_feature (119)..(119): n is a, c, g, or t
tcagcgatcgtatacacgaccggtgctcgatttagtctgatcgagaagggaaagggcagcgtcactctgttcccgccctcctctcgtagcactctgagcgggctggcaaggcgcatagn

SEQ ID NO: 266153 - DNA, 540 bp, Homo sapiens
  misc_feature: GYAE6OF01CS3S8.23.80.H03.1.454.CMB.1.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (514)..(514): a, c, t, g, unknown or other
  misc_feature (514)..(514): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaancacctccaacattgggactcatggtgtttcctggtaccagcagatcgcaggaacagccccccaattcncatctttgacagttataaacgctctcaggtactcctgaccgcttctctggctccaagtctggcacgtcagccaccctggacatcaccggactccagacgtggggacgaggccgtatttacttacgtggacggaaacagtcggggaatacaagccttcgagtggcttgggtgttcggcgggagggaaccaacgtgacccgtcgtagggtcagcccaaggctcgcccctggccacgtcgtcgttcccnccctcctcactctcgctngngcggtc

SEQ ID NO: 266154 - DNA, 616 bp, Homo sapiens
  misc_feature: GYAE6OF01DNM7Y.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaattctcatctttgactagttataaacgactctcaggtactcctgaccgtcttctctggctccaagtctggcacgtcacgcccaccctggacatcaccggactccgagacgtggggacgaggccgatttactactgacggaactagtgggaatacgaagcctagagtggcgttggggtcgttcgggacggagggaacccaaacgtcggaacccggttccgtacggggtaccacggacccgaagggtcctaccggccccccgttcgggtccaccgttccgttccgttacccccaccccgttccctacctaacttacccgtccggtaccgttccgttcgggacggtccggggtacg

SEQ ID NO: 266155 - DNA, 641 bp, Homo sapiens
  misc_feature: GYAE6OF01DZDPK.23.80.H03.1.454.CMB.1.raw
  modified_base (397)..(397): a, c, t, g, unknown or other
  misc_feature (397)..(397): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggccccaggacaggcggtcaccatttcctgctcgggaagcacctccaacattgggactcatggtgtttcctggtaccagcagatcgcaggaacacgcccccaattctcatctttgacagttaataaacgactctcaggtactcctgaccgtctttctctcggctccaagtctggcacgtcacgcccacctgacatccaccggactccagacgtgggacgaggcctattagttacnggacggaacagtgggaataacgaacgcctagaggtggcgttggggtcgttccgggacggaacgggaaccctaaacgtcggaacccgttccggtacggggtaccaacggccccgaaagggtccctacccgggtccccccgttacgggtaccctaacccgttccgttaccggtttcccctccggtccccccttccgttacctacgtttacccgtccggtcccgttccgtcgggacgggtcccgggg

SEQ ID NO: 266156 - DNA, 552 bp, Homo sapiens
  misc_feature: GYAE6OF01A7UVJ.23.80.H03.1.454.CMB.1.raw
  modified_base (542)..(542): a, c, t, g, unknown or other
  misc_feature (542)..(542): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgactctcaggtactcctgaccgtcttctctggctccagtctggcacgtcagcccacctggacactcaccggactccagacgtggggacgaggccgtattacgtactggacggaacagtgggaactacgaagccctagaggtcggcgtggggtgttcgggcggacgggaacctaagtcgaccgtcgtgggtccacgccgaaggctccggccccctggtccacctcgtcgttcccgccctcctcactcgtcgcttcngcggcggtcg

SEQ ID NO: 266157 - DNA, 534 bp, Homo sapiens
  misc_feature: GYAE6OF01AK32H.23.80.H03.1.454.CMB.1.raw
  modified_base (399)..(399): a, c, t, g, unknown or other
  misc_feature (399)..(399): n is a, c, g, or t
  modified_base (473)..(473): a, c, t, g, unknown or other
  misc_feature (473)..(473): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgactctcaggtactcctgaccgcttctctggctccaagtctggcacgtcagccacctggacatcaccggactccagacgtggggaccaggcccgattactacgtgacggaacngtgggataacaaggcctcgagtggctgggtgttcggcggagggaccaagtgaccgtcgtgggtccagccaggcncgccctgcactcgtcgtcccaccctccgtcacttaccgtccgtacgccgtgacgtcggtcg

SEQ ID NO: 266158 - DNA, 563 bp, Homo sapiens
  misc_feature: GYAE6OF01EWHUI.23.80.H03.1.454.CMB.1.raw
  modified_base (490)..(490): a, c, t, g, unknown or other
  misc_feature (490)..(490): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgctctcaggtactcctgaccgcttctctggctccaagtctggcacgtcacgccacctggacatcaccggactccgagacgtggggaacgacggaccgtattatactgacggaacagtgggataacgaagcctagagtggcgtgggtcgttcgggcggaacgggaccaaacgtcggaccgtcgtgggtcacggcccaaggtccnccggtccccgtcggtccaccttccgtcgttccccgccctcctctacgtcctcgtcgttcncggnggccggtcg

SEQ ID NO: 266159 - DNA, 525 bp, Homo sapiens
  misc_feature: GYAE6OF01D36Z9.23.80.H03.1.454.CMB.1.raw
  modified_base (394)..(394): a, c, t, g, unknown or other
  misc_feature (394)..(394): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaatctcatctttgacagttataaacgactctcaggtactcctgaccgcttctctggctcaagtctggcacgtcagccacctggacatcaccggactccagactggggacgaggccgattattactgcggaacntagggatacaagcctcagtggctgggtgttcggcggaggaccaaacgtcggacccgtcgtgggtcacgcccaaggcctcgcccctggtccactcgtcgtcccgccctctcatactcgctntgngcgggtcg

SEQ ID NO: 266160 - DNA, 571 bp, Homo sapiens
  misc_feature: GYAE6OF01BLK82.23.80.H03.1.454.CMB.1.raw
  modified_base (561)..(561): a, c, t, g, unknown or other
  misc_feature (561)..(561): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcacttttctgcggccccaggacaggcggtcaccatttcctgctcgggaagcacctccaacattgggactcatggtgtttcctggtaccagcagatcgcaggaacacgcccccaattctcatctttgacagttaataaacgactctcaggtactcctgaccgtcttctctggctccaagtctggcacgtcagccaccgtgacatccaccggactccgagaccgtggggaacgaggccgtaatttacgttactggacggaacagtagggaatacgaacgcctacgaggtggccgttgggtcggttcggcgggtaagggaccctaaacgtggaacccgtcgtcgggtacacggccgaaggcctcggccccctggtccacttccgtcgttcccgccctctcacgtactcgcgtngtcgcggtcg

SEQ ID NO: 266161 - DNA, 553 bp, Homo sapiens
  misc_feature: GYAE6OF01DQM5U.23.80.H03.1.454.CMB.1.raw
  modified_base (529)..(529): a, c, t, g, unknown or other
  misc_feature (529)..(529): n is a, c, g, or t
  modified_base (545)..(545): a, c, t, g, unknown or other
  misc_feature (545)..(545): n is a, c, g, or t
tcagacgcgagtatcacgaccggtgctcgatttagctgtgcgtcgaagggaaaggggacaatcttcatcatgacctgctcccctctcctcctcacccttatcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgccccccaacttctcatctttgacagttataaacgctctcaggtactcctgaccgcttctctggctccaagtctggcacgtcagccacctggacatcaccggactccagacgtggggacgaggccgattacttactggacggaacagtgggatacgaagccctcgaggtggcgtggggtcgttcgggcggaagggaccaaacgtcgaccgtccgtgggtcacgcccaagggcctacgccccctggtccacttccgtcgttccccacccttccncatacctcgcgtctgnggcggtcg

SEQ ID NO: 266162 - DNA, 598 bp, Homo sapiens
  misc_feature: GYAE6OF01BQMJ9.23.80.H03.1.454.CMB.1.raw
  modified_base (301)..(301): a, c, t, g, unknown or other
  misc_feature (301)..(301): n is a, c, g, or t
  modified_base (428)..(428): a, c, t, g, unknown or other
  misc_feature (428)..(428): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctggtcaggccgtgggggagtcccctgagtaatttcctgtacatcctctgaattcagttccttatacctggaactgggtccncaggctccgagggaggcctagaggtggtctcgtccatcgagtcgaagctaagttagtttaaagtattagtggtggggtacaggtgaacgggcctcttcactactctaccgagacgacaacgccgaanaactacactgtactctagactaaatcgaaccagtcctaggagaacggcgaaggacgtacgggtataattacgttacgtggtagagaggaggagacgaagggagaaggtaggtcgggacccgcgaaccgggaccccggaaccgttcgggtacctacccggtctccgtaccg

SEQ ID NO: 266163 - DNA, 562 bp, Homo sapiens
  misc_feature: GYAE6OF01CFHRQ.23.80.H03.1.454.CMB.1.raw
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgtggccccaggacaggcggtcaccatttcctgctcgggaagcacctccaacattgggactcatggtgtttcctggtaccagcagatcgcaggaacacgcccccaattcctcatctttgactagttataaacgctctcacggtactcctgaccgctctctgcctcaagtctgcacgtcacgccaccgtgacataccacggactccagaccgtggggacaggccgtatttactacgtgacggaactagtagggaatacgaagcctgagtggacgttgggtcgttcgggacggacggaacctaacgtcgaccgtccgtagggtcacggtcccgaggcgtaccgcccctggtcctacgttccgtcgtccccaccttcactactaccgtcgacgtncggngtcggtcg

SEQ ID NO: 266164 - DNA, 670 bp, Homo sapiens
  misc_feature: GYAE6OF01CVPCD.23.80.H03.1.454.CMB.1.raw
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
  modified_base (199)..(199): a, c, t, g, unknown or other
  misc_feature (199)..(199): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttcngccggccccaggacaggcgtcaccatttccngctcgggaancacctccaacattgggactcatggtgtttcctggtaccagcagatcgacaggaacacgacccccaattctcattctttacgactagttaataaacgtactcctactacggtactccctacgaccgtctttccgtcgtacggtcctaccgtaaacggtccgtaggcctaccgtcaaccggtacccgtacccgttacggaacacctaccgaacccggtacctaccgaacgacggtacggggaacggacggaccgtattaacgtcgtacggacggaacacggtagggaactaacgaagacctaggacgtgggtacgtgggtcggttacgggacgggaacgggaacctaacgtcggaccgttccggtacgggtacaccggtaccgaggtacctccgtcccgacgtcctaccgtccgttaccgtcccgtaccctcctaccgacgtacccgtcgaccgttgacggtcggcggtcggg

SEQ ID NO: 266165 - DNA, 552 bp, Homo sapiens
  misc_feature: GYAE6OF01B2FTW.23.80.H03.1.454.CMB.1.raw
  modified_base (296)..(296): a, c, t, g, unknown or other
  misc_feature (296)..(296): n is a, c, g, or t
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (461)..(461): a, c, t, g, unknown or other
  misc_feature (461)..(461): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggagcctggtcaggcctggggagtccctgagaatttcctgtacatcctctgaattcagttccttatacctggaactgggtccncaggctccgagggaggcctaggagtgggtctcgtccatcagtcgaagcagtagtttaaagnttatggtgggtcagtgaagggccnttcaccatctccagacgacaacgccgaagaactacactgtatctgacaatcgaccagcctagaagagcgaggcgagggtntatattactgtgtgagaggagacgagggagaggtagtcgggccgcgacggacccccgggtacctcgggtacccacccgttctccgttaccg

SEQ ID NO: 266166 - DNA, 695 bp, Homo sapiens
  misc_feature: GYAE6OF01CG5MO.23.80.H03.1.454.CMB.1.raw
  modified_base (268)..(268): a, c, t, g, unknown or other
  misc_feature (268)..(268): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcacctatttcctgctcgggaagcacctccaacattggactcatggtgtttcctggtaccagcagatcgcaggaacacgcccccaattcncattcgttgactagttataacgactctacaggtactctgaccgtcttctctggctaccagtctagccacgtcacgccaccgtggaccacgtccaccggacctccgaacgacggtacggggaaccgacggacccgtagtttaacgttacgtacggaacggtaaacctaggtacggggaaactaaaccgaacggtcctacggaggtacgggtccggttaggggttcgttccgggaccggggtaacgggaaccctaaacggttccggaacccggttcggtacggggtaccgaaccggaccccgaacgggtcctacccggtcccccgttcggtaccgtacccgttcccgttcccgggttccccccgacccttcccgttacctaacccgttaccgtccggtaccgttccgacgggtccggtaccggggtccg

SEQ ID NO: 266167 - DNA, 652 bp, Homo sapiens
  misc_feature: GYAE6OF01EICDS.23.80.H03.1.454.CMB.1.raw
  modified_base (159)..(159): a, c, t, g, unknown or other
  misc_feature (159)..(159): n is a, c, g, or t
  modified_base (401)..(401): a, c, t, g, unknown or other
  misc_feature (401)..(401): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttcngcggccccaggacaggcggtcaccatttcctgctcgggaagcacctccaacattgggactcatggtgtttcctggtaccagcagatcgcaggaacacgcccccaattctcatctttgactagttaataaacgctctcagtactcctcgaccgtcttctctcggctcaagtctggcacgtcacgcccacctggacatccaccggactccgagacgtggggacgacggaccgtattacgtacgnggacggaactagtacgggaactaacgaacgtcctagaggtcggtcgttggggttcggttccgggacgggtacgggaacctaaacgtcggtaacccggttccggtacgggtaccacgggacccgtaacgggtccgtcccggtccccgtccgggttaccacccggtttccgttcccggttaccccctacccctcccgttaccgtaccgttacccgttccggtacccgttacgtcggacgggtcccgggtacgg

SEQ ID NO: 266168 - DNA, 545 bp, Homo sapiens
  misc_feature: GYAE6OF01D5PXM.23.80.H03.1.454.CMB.1.raw
  modified_base (284)..(284): a, c, t, g, unknown or other
  misc_feature (284)..(284): n is a, c, g, or t
  modified_base (413)..(413): a, c, t, g, unknown or other
  misc_feature (413)..(413): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagccccccaattctcatctttgacagttanaaacgactctcaggtactcctgaccgcttctctggctccaagtctggcacgtcagccacctggacatcaccggactccagactggggacaggccattatactgacggaacagtgggatacgaagcctanagtgcgtgggtgtcgggcggggacaagggtcgaccggtcgaggtcagcccgaaggtcctcgcccccgtcggtcaccgtcgtcgttccccgcccttcctcacttcctcgtcgtctggacggcgggcgtacggg

SEQ ID NO: 266169 - DNA, 637 bp, Homo sapiens
  misc_feature: GYAE6OF01D7HHZ.23.80.H03.1.454.CMB.1.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcacctatttccngctcgggaanccacctccaacagttgggactcattggttgtttcctggtaccagcagatcgcaggaacacgcccccaattctcattctttgactagttaataaacgtactctctaggtacctcctcgaccgtcttctcgtgcctccaagtctggcacgtcacgcccaccgtggacactaccaccggtactccgagtacgtggggacgacggcctattacgtacgtgacgaacagtagggaatacgaacgtcctagaggtcggtacgtgggtcgttacgggacggaacggaacccaacgtcggtacccggtccgtcgggtaccaccggacccgaacggtccctacccggcccccgttcggtccctaccgttcccgtcccgtaccccctaccccgtcctaccgtaccttaccgtccgtaccgttaccgtcggacgggtccgggtaccg

SEQ ID NO: 266170 - DNA, 617 bp, Homo sapiens
  misc_feature: GYAE6OF01A8OU7.23.80.H03.1.454.CMB.1.raw
  modified_base (392)..(392): a, c, t, g, unknown or other
  misc_feature (392)..(392): n is a, c, g, or t
  modified_base (509)..(509): a, c, t, g, unknown or other
  misc_feature (509)..(509): n is a, c, g, or t
  modified_base (521)..(521): a, c, t, g, unknown or other
  misc_feature (521)..(521): n is a, c, g, or t
  modified_base (551)..(551): a, c, t, g, unknown or other
  misc_feature (551)..(551): n is a, c, g, or t
  modified_base (607)..(607): a, c, t, g, unknown or other
  misc_feature (607)..(607): n is a, c, g, or t
tcagacgcgagtatcacgaccggtgctcgatttagctgtgcgtcgaaggggaaaggggggagagaggagccttaggccctggtagtttccggaaaggccgtaatccacttgggtccgatcagcgactgaggcaccgaggcttccaccatggaactggggctcggctgggtttccttgtcgctatttagaagctggtccagtgtggaggtgctagggtggtggagtcgtggggggaggcctggtcaggccgtgggggatccctgagaatttcctgtacatcctctgaattcagttccttaataccctggaactggggtcccgcaggcctccgaggggaacgggcctaggaggtgggtctcgtccatcaggtcgaagctaagtagtttaaaatnttagtggtggggtacagtggaagggccgtcttcacctatctaccagagacaacgccgaagatacactgtactctgacaaatcgaccaggcctggaagagcgaaggacgtaggggttntaattagttacnggttgtaggaggtaggagacgagggtaagnggtagttcgggccacgtaccgggacccccgggtaaccgttcggacctacccggttntccgttaccg

SEQ ID NO: 266171 - DNA, 651 bp, Homo sapiens
  misc_feature: GYAE6OF01B9TMI.23.80.H03.1.454.CMB.1.raw
  modified_base (232)..(232): a, c, t, g, unknown or other
  misc_feature (232)..(232): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttccnggtaccagcagatcgcaggaacacgccccccaattctcatctttgacagttataaacgctctcaggtacctcctgaccgtcttctctggctccaagtctggcacgtcacgccacccgtggacactcgacccggactccgaggaccgtggggaccgacgggcccgtaagtttacgtacgtggaccggaaactagtacggggaactaacgaacgtccctacgaggttcgggcgttggggttcggtttccgggacgggtaacgggaaccctaaacggtccggtacccggttaccgtaggggttccaaccggaccccggtaaggtccctaccggcccccgttcggtaccaccgttcccgttccgttccccgtcccttcctacctacgttaccgtccgcggttacctcggcggtccgggtaccg

SEQ ID NO: 266172 - DNA, 728 bp, Homo sapiens
  misc_feature: GYAE6OF01BLIXM.23.80.H03.1.454.CMB.1.raw
  modified_base (256)..(256): a, c, t, g, unknown or other
  misc_feature (256)..(256): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggcccaggacaggcggtcaccatttcctgctcgggaagcacctccaacattgggactcatggtcgtttcctggtaccagcagatcgcaggaacncgaccccaacttctcatcttgactagtaataaacgtactctacacggtacctccgtcgaccgtcttcctcgtcggaccttaccgaagtccgtcggtaccgtacgtcgacgacccgtacccgtacggaacctacgtccgaacccggtactacccgagtaccggtaggggaccgaggacccgtattaacgtcgtacggacggtaacaggtacggaactaacgaacggacctacggaagtcggtacggtcgggtacggttccgggaccgggaagggtaacccgtaacggtcggtaacccggttccggtacggggtaccgaccggtacccgaacgggtcccgtacccggtcccccgtttacgggttaccgttcccgttcccggtttaccccccgcccctttacccgtcccgtaccggttaccccgttcccggtcccggttacggttacggacccgggtccgggtccgtaaccgggg

SEQ ID NO: 266173 - DNA, 712 bp, Homo sapiens
  misc_feature: GYAE6OF01AU1HQ.23.80.H03.1.454.CMB.1.raw
  modified_base (269)..(269): a, c, t, g, unknown or other
  misc_feature (269)..(269): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttcncatctttgactagttaataacgactctcgagtactcctgacccgtcttctctggctccagtctggcacgtcacgcccaccgtggacacgtccgacccggacctccgacggtaccgtggggaaccgacgggaccgtaatttacgttaaccgtcggacggaacgtagtacgggtaataaccgaacgccctacggaggttacgggtaccggttggggttacggttaccgggacgggtaacgggaacccgtaaacgttcggaacccggttccggtacgggtaccgacggtaacccccgtaacgggtccctccgggtccccccgttacgggtaccctaaccgtttcccgtcccggtttaccccccgtccccgttccccgtttacccgaaccgtttacccgttccccggttacccgttaccggtaccggaccgggtccggggtacccgg

SEQ ID NO: 266174 - DNA, 719 bp, Homo sapiens
  misc_feature: GYAE6OF01C34ID.23.80.H03.1.454.CMB.1.raw
  modified_base (122)..(122): a, c, t, g, unknown or other
  misc_feature (122)..(122): n is a, c, g, or t
  modified_base (161)..(161): a, c, t, g, unknown or other
  misc_feature (161)..(161): n is a, c, g, or t
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
tcagacgcgagtatcacgaccggtgctcgatttagctgtgcgtcgaaagggaaaggggacaatcttcatcatgacctgctcccctctcctcctcacccttctcattcactgcacagggtcgngggcccagtctccattgacgcagcccgccctcactttcncgccggcccaggacaggcggtcaccatttccngctcgggaancacctccaanagttgggactcattggtgtttccaggtaccngcaagacncgacaacggaacaccgcccccaattctcaacttctttgactaagttaaactaaaacgcttctaccgaaggtacctccgtagacctcttctcgtcggctacctaagtctcggcacggtcaccgcccaccgtaggacactaccgaacccggttcacccggaaggacggtcgggggaaccgacggtacccgtaattttaacgttaaccggcgggaacgtaacgagttagggaactaaaccgaacgtcctagacggtggtccggtgggtacggttaccgggacggaacggaacctaacggccgtaacccggtccggttagggaccgaaccggtacccgaacgggtcccgtcccggtaacccccgttcggtaccctaaccgttcccgtttaccccggttacccccacccccttcttaccctaacgttacccgttccgggtactcgggttacggaccgggtcggggtacccgg

SEQ ID NO: 266175 - DNA, 801 bp, Homo sapiens
  misc_feature: GYAE6OF01B61HA.23.80.H03.1.454.CMB.1.raw
  modified_base (192)..(192): a, c, t, g, unknown or other
  misc_feature (192)..(192): n is a, c, g, or t
  modified_base (203)..(203): a, c, t, g, unknown or other
  misc_feature (203)..(203): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagcccgccctcactttctgcggccccaggacaggcggtcacctatttccngcgtcgggaancacctccaacagttgggactctagttggttgtttcctggtaaccaggtcaggtatcgacgaacggaacaccgccccctaacttctcattctttagactagttaactaaacgactctactacggttacctccgtacgaccgtcttcctcgtcggccttaccgtaagtccgttcggacctaccggtacaccgtacccgtaccccgtaggtaaccacgttaccgaacccgggaacctccgaacggaccgttacggggaaccgtacgggacccgttaagtttaacgttaccgtacggaaccggtaacgtaacggtcgggtaaacgtaaaccgtaaccggtccctacggtacgggtacgggttacggtacggggtttacggtttccggggaaccgggtaacgggtaaccgtaaacggtccggtaacccggttcccggtaaggggtcccaaccgggtaccccgtaacgggtcccgtacccggtccccccggttacggtaccctaacccgtttccgtcccggttacccccgtacccttccccgttaccgaacccgtttcccggtaccccggtacttaccgtcgggtaccggtcccgggttaccgg

SEQ ID NO: 266176 - DNA, 680 bp, Homo sapiens
  misc_feature: GYAE6OF01ADCA3.23.80.H03.1.454.CMB.1.raw
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (469)..(469): a, c, t, g, unknown or other
  misc_feature (469)..(469): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctccgctgggttttcctgtcgctattttagaagctgtccagtgtgaggtgcgaggtggtggagtcgtgggggagccgtggtcaggccgtggggacgtccctgagtaatttcctgtacatcctntgaacttcagttccttatacctggaactcgggtcccnccaggcctaccgaaggggaacggcctaggagtggtctccgtccatcgagtcgaagcgtaagttaagtttaaagtattagtgggtgggtacaggtaggaacgggtcctcttacaccctatcctacgaagacgaacaaccggcgaagtaactacacgtagtaactcgtanacaaatcgaaccacgccgtagaacggtaacgcggaacgggtaaccgtaacgggttagtaagttaacgtttacgtagggttcgtaggaacggtaagggaacggaacggaagggtaggtaacgggtacgggttccgggacccggtaccgaacccggggtaccccgggtaaaccccggttacggtacccgtacccgttccgttccgttacccgg

SEQ ID NO: 266177 - DNA, 916 bp, Homo sapiens
  misc_feature: GYAE6OF01C7D6F.23.80.H03.1.454.CMB.1.raw
  modified_base (220)..(220): a, c, t, g, unknown or other
  misc_feature (220)..(220): n is a, c, g, or t
tcagacgcgagtatcacgaccggtgctcgatttagctgtgcgtcgaaagggaaaggggacaatcttcatcatgacctgctcccctctcctcctcacccttctcattcactgcacagggtcgtcgggcccagtctccattgacgcacgcccgccctctacttttctcgccggccccaggaccgacggccggtccacctactttcctgccgtacggggaacncctaccctaccaacgtagtttcgggactcgagttggtttcgtttccgtacgggtaccagaccgagtactccggacaacgggaaaccaacccgtacccccctaactttcctaccttaacgtttcctttacggaaccttaagttaacgtaaaaccgtaccttctaccgtaacgtaccttcccgtacgtacccgtcctttcctcgtacggtacccttaccgtaacgttccgtacggtaccgtacccgttacgtacccgaccccgtaaccggttacgggaaccctaaccgttaccccggaaaccccggttaaccgtacccggaaacggtacccgggtacggggaacggtaaccggtacccgttaagtttaacgttaccggtacggaacggtaacgtaaggtacgggtaaactaacggtaccgtaccgtagtacgggtcgggttcggtacggggttacggttacccggggacgggtaaacggtaaaccccgttaaagggttccccggtaccggtttacccggtaacgggtacccgaacccgggacccggttaacgggtccccggtaccccggttacccccgttacggtacccctaacccgttcccgttaccccggtttacccccgacccctttcccgtaccgttaaacccgttcccgtccggtttaacccggtccggtacgggtcccggtcccgggtacgg

SEQ ID NO: 266178 - DNA, 528 bp, Homo sapiens
  misc_feature: GYAE6OF01BDXPO.23.80.H03.1.454.CMB.1.raw
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (520)..(520): a, c, t, g, unknown or other
  misc_feature (520)..(520): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtctgggggaggcctggtcaggcctgggggagtccctgagaatttcctgtacatcctctgaattcagtccttatacctggaactgggtccgccaggctccgagggaaggcctagagtgggtctcgtccatcagtcgaagcagtagttaaagtattatgtgggtcagtgaagggccnttcaccatctcaganacacgcgagatacactgtatctgacaatgacagcctgagaagcgaggacgacgggtgtatattactgtgtgagaggagacgaggagagtagtcggccgcgacggcccgggacctggaccaccgtntcgtaccg

SEQ ID NO: 266179 - DNA, 777 bp, Homo sapiens
  misc_feature: GYAE6OF01BVSJW.23.80.H03.1.454.CMB.1.raw
  modified_base (323)..(323): a, c, t, g, unknown or other
  misc_feature (323)..(323): n is a, c, g, or t
tcagacgcgagtatcacgaccggtgctcgatttagctgtgcgtcgaagggaaaggggagagaggagccttagccctggattccaaggcctatccacttggtgatcagcactgagcaccgaggcttcaccatggaactgggctccgctgggtttccttgtcgctattttagaagctgtccagtgtgaggtgcaggtggtggagtcgtgggggagccgtggtcaggccgtgggggacttcccgtgacgtaattttccctgtacacttccgtctagtaacttcgtaacgttcccttaataccgtaggtaaaccgttcggggtcccnccgagggcctaccggaagggggaacgggtccttaaggacggttcggggttcctccggtacctatccgaaggttacgaaaggtctaaaggtttaagttttaaaagtatttagtggtcggggtactaaggtggaaacggggtccctactttaccgaacctaagttccctacccgaaggaacgaaccgaaccgaccgtaaagaacgtaaccgtacttagtaactcgttacgaacaaacgtacgaacccgtaacgtccgtaacggaacggaaacggaccggaaacgggaacccggtaaggggttagttaacgttaagtttaaccgtaggttaacggttaggaagggaaggaacggaacgaaggggaagaacgggtaggttaccgggacccgtaccggaaccgggtaacccccgggtaaacccggttcggtacccgtacccgttcgtacccgttaccgg

SEQ ID NO: 266180 - DNA, 670 bp, Homo sapiens
  misc_feature: GYAE6OF01DXX3A.23.80.H03.1.454.CMB.1.raw
tcagacgcgagtatcacgaccggtgctcgatttagctgtgcgtcgaaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggttgtttcctggtaccagcagatcgcaggaacacgcccccaacttctcattctttagactagttaactaaacgactctcaggtactccgtgaccgtcttcgtctcggctccaagtcgtcggcacgtcacgcccaccgtgaacagtccaccggtacctccgaagacgtacggggacgacgggtcctaatttacgtttacgtcggacggaaactagtagggtaactaacgaacgtccctacgagggttcggcggttcgggttgggttaccgggacgggtacggtaacccgaaacggtcgtacccggttcggtacgggtccaacggtacccgaagggtccctaccggtcccccgtcgggtaccctaccgtttcccgttccggttaccccctaccccttccctactaccgttaccgtccggtaccgttgtaccggcggtccgggtaccgg

SEQ ID NO: 266181 - DNA, 807 bp, Homo sapiens
  misc_feature: GYAE6OF01AEMHA.23.80.H03.1.454.CMB.1.raw
  modified_base (159)..(159): a, c, t, g, unknown or other
  misc_feature (159)..(159): n is a, c, g, or t
  modified_base (200)..(200): a, c, t, g, unknown or other
  misc_feature (200)..(200): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttcngcggccccaggacaggcggtcaccatttcctgctcgggaancacctcaacattgggactcattggtgtttcctggtaccagccagatcgacaggaaccacgacccccaattctacattctttgaactagttaacaaacgactctacaggtacctccgtgaccgtcttctcgtggcctccaagttcctggcctacgtcacgcccaacccgtggaaccacgtaccgacccggtacctaccgaggtaccggtcgggggaaaccgtacgggacccgttaagtttaaccgttaccggtacgggaacccgggaaacctacggtacgggggtaaaacttaacccggaaaccgggttccccttaaacggaacgggtttcgggtacccggtttacggggggttacggtttacccgggggaccgggtaaacggggtaaaccccgtaaaacggttccgggtaacccccgggttacggttacgggggttaaccccaaccggggtaacccccggtaaagggtccccgttacccgggtcccccccggttagggttaccccgtaaaccgtttcccggtttaccccggttacccctaaccccgttcccgtaccgtaaccgttaccgtcccggtacgtttacgacgggtaccgtccggggtaccg

SEQ ID NO: 266182 - DNA, 598 bp, Homo sapiens
  misc_feature: GYAE6OF01BOI25.23.80.H03.1.454.CMB.1.raw
  modified_base (257)..(257): a, c, t, g, unknown or other
  misc_feature (257)..(257): n is a, c, g, or t
  modified_base (302)..(302): a, c, t, g, unknown or other
  misc_feature (302)..(302): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagacgcgagtatcacgaccggtgctcgatttagctgtgcgtcgaagggaaagggggagagaggagccttagccctggattccaaggcctatcccacttggtgatcagcactgagcaccgaggcttcaccatggaactggggctccgcttgggttttccttgtcgcttattttagaagctgtccagtgtgaggtgcaggtggtggagtcgtgggggagcctggtcaggccgtggggacgtccctgagtaatttccngtacatcctctgaattcagttccttatacctggaactcgggtccncaggctccgagggaacggcctaggaggtgggtcctcgtccatcgagtacgaagtctaagttaacgtttaaagtattagtggtggggtacaggtggacggcgcttcaccatcncagacgacaacgcganaatacactgtatctagactaagtcaacacgtccgagaagaacgcggaacggtaacgtacgggttagtacttagtttacgtggttaggtagaaggaggagacgaaggaggagtacggtcggacccggacgaccggaccccggaccgtcggacctaccgtctccgtaccg

SEQ ID NO: 266183 - DNA, 634 bp, Homo sapiens
  misc_feature: GYAE6OF01AF487.23.80.H03.1.454.CMB.1.raw
  modified_base (425)..(425): a, c, t, g, unknown or other
  misc_feature (425)..(425): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgcgtcgggaagccacctccaacattgggactcagtggttgtttcctggtaccagcagatcgacacggaacaccgcccccaacttctcattctttgactagttactaaacgctctcgaggtactccgtcgaccgtcttctcgtcgctaccagtcgtgcacgtcacgccaccgtgacactccaccggacctcgacgacgtgggacgacggtccgtattacgttactaggacggaacnggtagggaactacgaacgccctagaggtggtcggttgggtcggtcgggacggacgggaaccaacgtcggacccggttcgtacgggtccaccgccggacgtccgtcccgtccccgtcgtacctaccgtacccgttcccggttacccccacccgttccctacgtaccttaccgtcccggtcgttaccggtcggtccggggccgggtaccgg

SEQ ID NO: 266184 - DNA, 784 bp, Homo sapiens
  misc_feature: GYAE6OF01APK50.23.80.H03.1.454.CMB.1.raw
  modified_base (270)..(270): a, c, t, g, unknown or other
  misc_feature (270)..(270): n is a, c, g, or t
  modified_base (766)..(766): a, c, t, g, unknown or other
  misc_feature (766)..(766): n is a, c, g, or t
tcagacgcgagtatcacgaccggtgctcgatttagctgtgcgtcgaagggaaagggacaatcttcatcatgacctgctcccctctcctcctcacccttctcattcactgcacagggtcgtgggcccagtctccattgacgcagccgccctcactttctgcggccccaggacaggccggtcacctatttcctgctcgggaagccacctccaacattgggactcatggttcgtttcctaggtaccaagcagtacgtccgacgaacggaaccncccgaccccctaactttcctactacttctttacgaacttaacgttaacgtaaaccgtcctaccgtacgtaacggttaccttccgtccgtaccctctttcccgtcggtccggtacctaccgtaacggttcgtcgtaccgtaccgtaccgacctaccccgtaaccgtacggaactaccgtaccccggaaccgtacccgtaccgtaacgggtaaccgggtacggggaaccgtacccggtacgtttaacgtttaaccgtcgtacggtaaccgtaacgtacggtagggtaacctacgtaccgaccgtgagtccggtacggtcgggtcggtacggggcggtaaccgggtaaccaacggttccgaacccggttcggtacgggtaccgaccgaccggtaccgtccgtccccggtcccgtaccggtcctacccgttccgttcccgtacccccgttaccctccgttaccgtaccgtcccggttacccggtcgttaccggtaccggnggggttccccgggtacgg

SEQ ID NO: 266185 - DNA, 729 bp, Homo sapiens
  misc_feature: GYAE6OF01C8PEI.23.80.H03.1.454.CMB.1.raw
  modified_base (158)..(158): a, c, t, g, unknown or other
  misc_feature (158)..(158): n is a, c, g, or t
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (275)..(275): a, c, t, g, unknown or other
  misc_feature (275)..(275): n is a, c, g, or t
  modified_base (341)..(341): a, c, t, g, unknown or other
  misc_feature (341)..(341): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttcngccggccccaggacaggcggtcaccatttccngcgtcgggaanccacctccaacattgggactcagttggtctttccnggtaccagcagatcganaggaacacgacccccaattccnctattctttagaactagttaataaaccgacttctacgaacggtacctcctgtaccgtcttttccgnggtcctacgaagttcgtaggcctacgtccagcccaccgtggaaccacgtccgaacccggactccgaagtacggtacgggacgacggtccgtaatttactaccgtgaccgggaataggtagggaactaacgaacgccgtagacggttgggaccgtttggggtacggttaccgggacgggtaacgggaaccgtaaaccggtcggaaccccggttccggtcgggtaacctaccggaccgtacgggtaccctccgggtacccccccttgggtaccctaccggttacccgttcccgttaacccccgtaccccgttcccgttacctaaccgttaaccccgttccggtacccgtttacggtaccggacccgggttccggggttccgtacccgggg

SEQ ID NO: 266186 - DNA, 645 bp, Homo sapiens
  misc_feature: GYAE6OF01BZAXA.23.80.H03.1.454.CMB.1.raw
  modified_base (164)..(164): a, c, t, g, unknown or other
  misc_feature (164)..(164): n is a, c, g, or t
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
  modified_base (314)..(314): a, c, t, g, unknown or other
  misc_feature (314)..(314): n is a, c, g, or t
  modified_base (394)..(394): a, c, t, g, unknown or other
  misc_feature (394)..(394): n is a, c, g, or t
  modified_base (631)..(631): a, c, t, g, unknown or other
  misc_feature (631)..(631): n is a, c, g, or t
tcagacgcgagtatcacgaccggtgctcgatttagctgtgcgtcggaagggaaaggggacaatcttcatcatgacctgctcccctctcctcctcacccttctcattcactgcacagggtcgtgggcccagtctccattgacgcacgcccgtccctctactttcncggccggccccagggacaggcggtccaacctnttcccgtgcgacgggaatccacctaccaactagttgggacctnagttggttctttccgnggtaccagcagactcgcgaagaaccncgaccccctaattctcattcttagactagttanaaacgctctacgacggtacctcctagcctcttctcgtcgacctacgtaagtcgtcggctaccgtagaccgcccgtaaccncggaactacgtacccggaaccggacctaaccgacggtacgggtaacggggtaccgacggtaccgttaattacgttacgaggacgaacgtagtacggaactagaacgtcgagtagcgggtagtggggtgtacgggcggtaacggaactaacgtcgaccgtcgtacgacgaccgtacgacgtccaccgtcccgtcgtccactccgtcctaccccgactccgactaccgtactcgtccgngtggccgtcggacg

SEQ ID NO: 266187 - DNA, 816 bp, Homo sapiens
  misc_feature: GYAE6OF01BAGS9.23.80.H03.1.454.CMB.1.raw
tcagacgcgagtatcacgaccggtgctcgatttagctgtgcgtcgaagggaaagggacaatcttcatcatgacctgctcccctctcctcctcacccttctcattcactgcacagggtcgtgggcccagtctccattgacgcacgcccgccctcacttttctgccggccccaggacaggcggtcacctatttcctgctcgggaagccacctccaacagttgggactcagttggttcgtttccgtggtaccaggcaagatcggacacggaaccacgccccccaacttcctcattctttagactagttaactaaacgtacttctcgacggtacttcctcgaccgtctttcgtctcggtcctaccgtaaagttccgtacggtacctaccggttaccgaccgtaccccgtaccccgttagggaaccctacgttaccccgaaccccgggtaaccttaccgaacggtaccggtacggggaaccggacgggtaccgtaagtttaacgttaccgtacggaccggtaaacgtaacggtaggggtaacctaacggtaaccgtccgtacggtacggtcgggtcggttacggggttacggttccggggacgggtaacgggtaaacccgtaaacgtaccgggtaacccggttccgggtacgggtacccgaaccggtacccggtaaccggcccgttaccccggtccccgttaccgggttacccttacccggttcccgttaccccggttcccccgtcccccgtttcccgtacccgtaaccgttcccgttccggtcccgttaccggtaccgggaccgggtcccgggtaccggg

SEQ ID NO: 266188 - DNA, 804 bp, Homo sapiens
  misc_feature: GYAE6OF01A2J3R.23.80.H03.1.454.CMB.1.raw
  modified_base (170)..(170): a, c, t, g, unknown or other
  misc_feature (170)..(170): n is a, c, g, or t
  modified_base (268)..(268): a, c, t, g, unknown or other
  misc_feature (268)..(268): n is a, c, g, or t
tcagacgcgagtatcacgaccggtgctcgatttagctgtgcgtcgaagggaaagggggagagaggagctagcctggatccaaggcctatccacttggtgatcagcactgagcaccgaggctcaccatcggaatgggcctccgctgggttttcctgtcgtctattttaganctgtccagtgtgaggtgcgaggtggtcggagttcggtggggggacggtcccgtggggtccacggggccgtaggggggctcccgtgacgtaattttccnggtacactcccttgtagacttcacgttccttagtaccgtaggaaccgtttcgggcccgtccgaggtcccgtacgaacgggggtaaccgggtcctaagggtcggttcggggtcttccgtaccgaacttccgtagggtaccgaagtaccgtaaggtttaacggtttaaaagttattaggttcggggttcggggtactaaggggttacgaacgggggccctttacgtaccaacgtacttccgtaccgaaaggaccgaaaccgtaaccggaccgtaacgaacgtactaaccgttagtaacgtcgtacggtaaactaacgtacgtaaccgccggtactaacggaacggtaaggaccggaacgggtaaccgtaaccggggtaagttacgttaacgtacggttaggtagttacggaagggtacggaacggacgaaagggacgggttaaggaccgggtttacccgggaccggtacggtaaccccgggaaccccgggtaacccgttacgggaccccgttaccggtacccgttcccgttaacccgg

SEQ ID NO: 266189 - DNA, 786 bp, Homo sapiens
  misc_feature: GYAE6OF01DHVGS.23.80.H03.1.454.CMB.1.raw
  modified_base (203)..(203): a, c, t, g, unknown or other
  misc_feature (203)..(203): n is a, c, g, or t
  modified_base (257)..(257): a, c, t, g, unknown or other
  misc_feature (257)..(257): n is a, c, g, or t
  modified_base (282)..(282): a, c, t, g, unknown or other
  misc_feature (282)..(282): n is a, c, g, or t
tcagacgcgagtatcacgaccggtgctcgatttagctgtgcgtcgaaagggaaaggggacaatcttcatcatgacctgctcccctctcctcctcacccttctcattcactgcacagggtcgtgggcccagtctccattgacgcagccgccctcactttctgccggcccaggacaggcggtcacctatttcctgcgtcgggaanccacctccgaacagtttcgggactcagttggttcgtttcctggtaccagcaggntacgcaggaacacgcccccaattcncatctttgactagtactaaacgactctacgaggtacctcctacgaccgtcttctcgtggcctaccaagtccgtagaccacgtcacgtcccaccgtggaccacgtccgaaccggtacctaccgagacgtcggggaacgacggtacgtaactttacgtacgtacggaccggtaaacgtaggtacgggtaactaaccgaaacgtccgttacgagggttcgggtccggttacggggttacggtttacccggggacggggtaaacccgggtaaccgtaaaccggttaccgggtaccccggtttaccgggtaccgggggttacccaacccgggtaaccccgtaacgggttcccgtaccccgggttacccccccgtttaacgggtaccccttaaccggtttcccgttccccggtttaaccccccttacccccggttcccttacccgttaaccgttaccccgttaccggtcccgtttaccggtacgggtaccgggtcccggggtaacccggg

SEQ ID NO: 266190 - DNA, 712 bp, Homo sapiens
  misc_feature: GYAE6OF01EKIR7.23.80.H03.1.454.CMB.1.raw
  modified_base (199)..(199): a, c, t, g, unknown or other
  misc_feature (199)..(199): n is a, c, g, or t
  modified_base (268)..(268): a, c, t, g, unknown or other
  misc_feature (268)..(268): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttctgcggccccaggacaggcggtcaccatttcctgctcgggaancacctccaacattgggactcatcggtgtttcctggtaccagcagatcgcaggaacacgcccccaattcncatctttgaactagttaacaaacgactcttcgaggtacctccgtcgaccgcttctctcggctaccgagtcgtgctacgtccacgcccaccgtgaccactccgaaccggtacctccgaacgtacggtacggggacggaacggtccggtaatttaacgttaacgtacggtaccggaaactaggtacgggaactaaccgaaagtcccgtacgtaggtacgggtcgtcggggttaggttacccggggcggtaaccgggaaacctaacggtacccggtacccgttaccggtacggggtaccgaacggaaccccgacgggtacccgtaccccggtcccccgttacggttaccctaccgtttccgtcccgtttccccccaacccggttccctacccgtaactttaccccggtacctcccgttacgtcgggtaacccggtcgggtaacccgg

SEQ ID NO: 266191 - DNA, 711 bp, Homo sapiens
  misc_feature: GYAE6OF01CLN0R.23.80.H03.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
  modified_base (267)..(267): a, c, t, g, unknown or other
  misc_feature (267)..(267): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaancacctccaacattgggactcatggtntttccnggtaccagcagatcgcaggacacgcccccaattcncatctttgactagttataaacgctctcaggtacctcctgaccgtcttctctggctcaagtctggcacgtcacgccaccgtgacactccaccggactccgagcgtacggggacgacggtccgtaatttacgttacgtcggaccggaaactaggtacggggaacttaaccgaaacgtcccgttacgaagggttcgggtcgttcgggggttacggtttccggggacgggtaacgggaaacccctaaaacggttccgggaacccggtttcccggttacggggtacccaaccggtacccccggaaacgggtcccgttacccggtacccccccgttcgggtacccctaaccgtttcccggttacccggttccccccgtaccccctttcccgtacccgtaaccttcccggttccggtacccggttccgtacggacgggtcccgggtaccgg

SEQ ID NO: 266192 - DNA, 588 bp, Homo sapiens
  misc_feature: GYAE6OF01E2EOD.23.80.H03.1.454.CMB.1.raw
  modified_base (268)..(268): a, c, t, g, unknown or other
  misc_feature (268)..(268): n is a, c, g, or t
  modified_base (402)..(402): a, c, t, g, unknown or other
  misc_feature (402)..(402): n is a, c, g, or t
  modified_base (441)..(441): a, c, t, g, unknown or other
  misc_feature (441)..(441): n is a, c, g, or t
  modified_base (572)..(572): a, c, t, g, unknown or other
  misc_feature (572)..(572): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctgggtcaggccgtgggggagtcccctgagtaatttcctgtacatcctntgaattcagtccttatacctggaactgggtccgccaggcctccgagggaggtctagaggtgggtctcgtccatcagtcgaagctagttaagtttaagtattatggtggggtctaggtgaagggcctcttcaccntcctcagacgacaacgccgaagaactacactgtactctnacaatgaccagcctagaagaacgcggaagggaccgtacggggtatacttaagtttactgtacgtaggagtaggagtacgaagggagagtaggttcggccgacgaccggaccccgggtaaccctgggacccnccggttctcgttaccg

SEQ ID NO: 266193 - DNA, 565 bp, Homo sapiens
  misc_feature: GYAE6OF01AV1WU.23.80.H03.1.454.CMB.1.raw
  modified_base (202)..(202): a, c, t, g, unknown or other
  misc_feature (202)..(202): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
  modified_base (518)..(518): a, c, t, g, unknown or other
  misc_feature (518)..(518): n is a, c, g, or t
  modified_base (530)..(530): a, c, t, g, unknown or other
  misc_feature (530)..(530): n is a, c, g, or t
  modified_base (556)..(556): a, c, t, g, unknown or other
  misc_feature (556)..(556): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagcccgccctcactttctgccggccccaggacaggcggtcaccatttcctgctcgggaancacctccaacattgggactcattggttgtttcctggtaccagcagatcgcaggaacacgccccccaattctcatctttgacagttataaacgactctcaggttactcctgaccgtctttctctggcctaccaagttctaggccacgtcacgcccaccctggacactccaacccggcctaccagacgtggggacgcggccgtatttacttacgtgaccggaacagtagggaataacgaacgcctagagtggcgttgggtcgttcgggnggaggaccaacgtcgaccgtcgngggtcacgccgaggcncgcccngtcnctctcgtacccncctcctctactccgtcgccgtgtcgnggcggtcgg

SEQ ID NO: 266194 - DNA, 645 bp, Homo sapiens
  misc_feature: GYAE6OF01A8N0P.23.80.H03.1.454.CMB.1.raw
  modified_base (199)..(199): a, c, t, g, unknown or other
  misc_feature (199)..(199): n is a, c, g, or t
tcagacgcgagtatcacgaccggtgctcgatttagctgtgcgtcgaagggaaagggacaatcttcatcatgacctgctcccctctcctcctcacccttctcattcactgcacagggtcgtgggcccagtctccattgacgcagccgccctcactttctgcggccccaggacaggcggtcaccatttcctgctcgggaancacctccaacattgggactcagtcgggttgtttccgtggtaccagcagatccgcaggaaccacgacccccctaattcctcattcgtttgactagttaactaacgactctcgacgtacctcctcgaccgtcttcgtctggctccgtaagtcgtggctacgtcacgcccacccgtgacctacgtaccgacccggtacctccgacggtaccgtacgggggaaccgtacggcccgtaattacgttacgtacggaccggtaacgtaggtacgggtaactaacgaacgtcctacgaggtggtcgtgggtcggtccgggcggaacgggaaccaacgtccgtaccgtcggtacggtaccgaccgaccgaacgccgtccgtccccgtcgtcctaccgttccgtccgtccccgtccctcctcctcgtccgtccgtccgtacgtcgtcggtcggtcg

SEQ ID NO: 266195 - DNA, 625 bp, Homo sapiens
  misc_feature: GYAE6OF01EW8GK.23.80.H03.1.454.CMB.1.raw
  modified_base (307)..(307): a, c, t, g, unknown or other
  misc_feature (307)..(307): n is a, c, g, or t
  modified_base (500)..(500): a, c, t, g, unknown or other
  misc_feature (500)..(500): n is a, c, g, or t
  modified_base (541)..(541): a, c, t, g, unknown or other
  misc_feature (541)..(541): n is a, c, g, or t
  modified_base (610)..(610): a, c, t, g, unknown or other
  misc_feature (610)..(610): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctccgctgggttttcctgtcgctattttagaagctgtccagtgtgaggtgcaggtggtggagtcgtgggggaggcctggtcaggccgtggggacgtccctgagtaacttttcctgtacatcctctagtaattcagttcccttatacccgtggaactcggggtcccnccaggcctaccgaggggaacggcctaggaggttgggtcctccggtaccatcaggtcgaagctaagtaagtttaaagatttagtggtaggggtcaggtggaacgggtcccgtcttacacccattcctaccaaggaacgaaccgaaccgaccgaagaaactactactagttatcgtagaactaaagtcgaaaccncgcctagaagaaggcgaaggacgagggtatatagttatggngtagaagaggagacgaaggagacgaggttccggacgcgaacccgggacccgggtaacccgtggtacccnccgttcgtcgtaccg

SEQ ID NO: 266196 - DNA, 811 bp, Homo sapiens
  misc_feature: GYAE6OF01DL782.23.80.H03.1.454.CMB.1.raw
  modified_base (164)..(164): a, c, t, g, unknown or other
  misc_feature (164)..(164): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
tcagacgcgagtatcacgaccggtgctcgatttagctgtgcgtcgaaagggaaagggacaatcttcatcatgacctgcctccctctcctcctccacccttctcattcactgcacgagggtcgtcgggcccagtctccattgacgcacgccgccctctactttcncgccggccccaggacgagggtccgtaccacctactttccgnggccgtacgggacncctacctaccaacgtagttcgggacctcgtagttcggttcgtttaccgtacgggtaccaggtacctaggtacgtccgacgaacggaaccgtaccccgtaccccctaacttcctaccttaacgtttacgtttacgaacgttaagttaaacctaaccgtaccttaccgtacgtacggttaccctccgttacgtacccgttctttccgacgtcgtacctaccgtacgtccgtcgacgtaccgtacgaccgaccctacggtacgtaccgtaaccgtacccgaacccggtacccgtacgaagggtaccgggtacgggaaccggtaccggtaccgttaagttacttaaccggcggaaccggtaacgtagggacgttaaactaccgtacgaccgttggtaggtggtaaccgggttcgggtaccggttacgggacggtaacgtaacctaacgggccggttaccgtccggtagggtaccgaccggtccgtaaccgggtcctaccccgggtcccgtagtccttaccgttcccgttccccgtacccctcccttggaccttaccggtcccgttacggcgtaacggccgggttcgtccgggaacg

SEQ ID NO: 266197 - DNA, 811 bp, Homo sapiens
  misc_feature: GYAE6OF01EV5V2.23.80.H03.1.454.CMB.1.raw
  modified_base (160)..(160): a, c, t, g, unknown or other
  misc_feature (160)..(160): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcacttttcgngccggcccaggacaggccggtcacctatttccctgcgtacgggaagccaccctaccaacgtagttgggaccttcagttggttcgttttccgtggtaacccagacgagatcggacgaacgggaaccaccggaccccccctaaactttcctacctacttccgttttagaaccttaagtttaaactaaaccgtacctccttaccgtaacggttaccctccgtacggtacccgtctttccgtcgtcggtccctaccgtaagttccgtaggtcctaacgtccgaccgtccccgaacccgttacggacctacgttacccgacccggtaaccttaccgaacgggtaccggtagggggaaccgtacgggtaccctaagtttaacgtttacgacgggtaccggaaacgtaggtaacgggtactaacgaacgtccgtacgtaacggtacggtcggtacgggttcggttaccgggacgggaaccggtaaaccgtaacgtaccggtacccgtaccggtacggtaccgacggacccgtacggcccggtcccgaccccgttaccgttaccgtaacccgttcccgttaccccgtacccctacccgttccctaccgtaccgttaccccgtccggttaccggtccgttcggaccggtcgggtacccgg

SEQ ID NO: 266198 - DNA, 786 bp, Homo sapiens
  misc_feature: GYAE6OF01BE3EZ.23.80.H03.1.454.CMB.1.raw
  modified_base (162)..(162): a, c, t, g, unknown or other
  misc_feature (162)..(162): n is a, c, g, or t
  modified_base (193)..(193): a, c, t, g, unknown or other
  misc_feature (193)..(193): n is a, c, g, or t
  modified_base (206)..(206): a, c, t, g, unknown or other
  misc_feature (206)..(206): n is a, c, g, or t
tcagacgcgagtatcacgaccggtgctcgatttagctgtgcgtcgaagggaaaggggacaatcttcatcatgacctgctcccctctcctcctcacccttctcattcactgcacgagggtcgtgggcccagtctccattgacgcacgccgccctctactttcngccggcccaggacaggcgtcacctatttccngcgtacgggaacnccaccctaccaactagttcgggacctcagttggttcgtttccgtaggtaccagtcagactcgacgaaggaaccaccgacccccctaacttcctctacttctttagactagttaactaaaccgtctctacgaggtacctccgtacgtaccgtctttccgtcgtcggtcctaccgtaagttcgtacggccgtacggtccaccgcccgtaccgtacgacctactaccgacccggacctcgaacggtaccgggtacggggaacgacgggtaccgttaagtttaccgtacgtacggacgtaacgtaggttacgggaactaaaccgacgtccgtacggtacggtgggtccggtttgggtccgggttacggggaacgggtaaccggggtaaacccctaagggtcccggtacccggttaccgggtaccggggtaaccgacccggtaaccccggtaacgggtccccgtcccggtaccccccggttcggttaaccctcccgtttcccgttccccgttaccccccgttacccgtcccgtaccgtacttacccggtcgttcccggtacgccgggtaccggtccgggtaccgg

SEQ ID NO: 266199 - DNA, 881 bp, Homo sapiens
  misc_feature: GYAE6OF01CXQX2.23.80.H03.1.454.CMB.1.raw
tcagacgcgagtatcacgaccggtgctcgatttagctgtgcgtcgaagggaaaggggacaatcttcatcatgacctgctccctctcctcctcacccttctcattcactgcacgagggtcgtgggcccagtctccattgacgctacgcccgccctctactttctcgccggccccaggacgaggccggtaccacctatttcctgccgtacgggaactccaacccttccgaaacgtacgttcgggaaccttccgtagttcgggtttcgttttacccgtacggggttaacccaggccaagggtaactcggaccgaaacgggaaacctaccccggacccccctaaactttccgtactaacctttccgttttacgaaaccgttacgtttaaactaaaaccgtccttcgttacgtaacggttacccttccgtacggaccgttccttcgtcgtacggcctaccgtaaggtccgtaggacctaaccgtcaaaccggtccctaaccgttacggaactaccgacccggtaacccgtacgtacccgaaacgggtaccggtacgggggtaaccgtaacggtacccgttaatttaaccggttacgtacgggaacggtaacgtacggtaacggaacttaaccgacgtcccgtagacggtcggtcgttagggttcggtaccgggacgggtaaccgaacctaaggtcccgtacccggtaccggttacgggtaaccgaccggtcccgtaacgggtccgtacccccggttaccccggttaacgttaacccgtttccttaccccgttacccccctacccgtttacccttaacgtacccggttaccccgttcggttaccccggtacgttacccggggaacggtcccggtcgggtaaacccgg

SEQ ID NO: 266200 - DNA, 870 bp, Homo sapiens
  misc_feature: GYAE6OF01DBU2C.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgaggcttcaccagtggacgtggggctccgcgttgggttttccttgtcgtcttatttagagtctgtccagtgtgaggtgcgaggtggtggaggtcggtgggggagccgtgggtcacggccgtggggactcccgtgagtactttcctagtacacttcctcgtagtaacttcgtacgttccttaatacccgtggtaaaccgttccggggtacccgacgtacgggcctaccgggaggggaaaccgggtccgtaaggtacggttcgggtaccttccggtaccataccgtaggtaccgaagtacctaaggtttaaagtttaaaacggttattaggtgggttagggggtactaaggttacgggaaacggggtccccgttacttaaccgtaacccgtaaccgtttccaaccgaaacgggtaacgtaaacccgtaaaccggacccggtaaaaggtaaaccttaacgtaaccgttaggttaactacgtacggtaaactaaacgtccggaaaccctacgggtacccgtaggaaacggaacgggaaccgggtaagggtaacccgttaaggggaacttttaacggttaacgtttaaccggttagggttaagtacgggtaaagggaaacggggtaacggaaccggtaaaggggtacggtaagggttaaccgggttacccggggacccggtacccggaaccccggggtacccccgggtaacccgttaccgggttacccctacccgggtttccgtacccgttaccgg

SEQ ID NO: 266201 - DNA, 1036 bp, Homo sapiens
  misc_feature: GYAE6OF01D9M5M.23.80.H03.1.454.CMB.1.raw
  modified_base (172)..(172): a, c, t, g, unknown or other
  misc_feature (172)..(172): n is a, c, g, or t
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
tcagacgcgagtatcacgaccggtgctcgatttagctgtgcgtcgaagggaaaggggacaatcttcatcatgacctgctcccctctcctcctcacccttctcattcactgcacgagggtcggtcggcccagttcctcctagttgaccgcacgcccgcccttctacttttcgngccggaccccaggacngggccgtcacctatttccngcgtcgggaancctaacccgtccaagtacgttcgggacctctagttggtttcgttttccccgtacgggtaccaggcctaaggacttccggaccgaaacggtaaccccgaccccgtaccccccctaattttccctacctaactttcctttacggaaactaacggtttaaacctaaccgaccttccttaccggtacgttaccccgttccgtaccgggtaccctttcgttacccgtttaccggtacggttcccttaaacgtacgttttccgggacgttcccccccggtaacgtaacgtaccccgaaccccccgttaaccgggttaccaaacccgttaccgttacccccgggaaacccgggtttaccccttaacgggaaaccccggtttaccgggggaacggggtaacccgttaacccgggtaacgtttaaaaccgttttaccggtaacgtaaccggggtaaacccggttaaacgtaacgggggtaaaccgggttaaaccctaaaccgggtacccgtccgttaaccgggttacggggtcccgggtttaacggggttcgggggtttaacccggtacccggggggaaacgggttaacccccggaaacccgttacgggtaacccgggttaccccgtcggggtttacccggaaacggtcccccgggttaacgggacccgttaccgggtccccccgttcccgggtacccggttaccccgttaccccgttacccgtttaccccccggtacccccttaccccggtttaccccaccggttaaaccttccccgggtaccttcccgggtacccgggtagggtccccggggtccggtaccgggg

SEQ ID NO: 266202 - DNA, 882 bp, Homo sapiens
  misc_feature: GYAE6OF01DV8UL.23.80.H03.1.454.CMB.1.raw
  modified_base (208)..(208): a, c, t, g, unknown or other
  misc_feature (208)..(208): n is a, c, g, or t
  modified_base (802)..(802): a, c, t, g, unknown or other
  misc_feature (802)..(802): n is a, c, g, or t
  modified_base (838)..(838): a, c, t, g, unknown or other
  misc_feature (838)..(838): n is a, c, g, or t
  modified_base (871)..(871): a, c, t, g, unknown or other
  misc_feature (871)..(871): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattcgacgcgacgccgccctctactttctgccggccccaggacgaggcgtcacctatttcctgcgtcgggaacncctaccctaccaacgtagtttcggggaaccttccgtaaggttcgggtttccgtttttcccgtacgggttaaccccgaggaccgtaaggtacgttacccgggaacgaaaccgggggtaaaccctaacccccggtaaccccccccgttaaccgttttacctttaaccgttaacgttttacccgttttaacggaaaccgtttaaacggtttaaaaccgtttaaaaccggtacccctttacccgttacccggtaaaccggggtttacccttacccggttaccggtaaccccggtttctttccgttaccggtcggtaccctaccggtaacgttcgtacggtaccgtaccgtacgaccgacccgtaccgtacgaccgtactaccggacccgtaactaccgagggtacggtcgggtaaccggacggtaccgttaacgtttaacgtacggacgggtaaccgttaacggtaggtacgggttaactaacggaacggtcccgtaacgtacgggtacgggttcggtacggggttcggtaccgggacgggtaaggtaacccctagtccgggtacctcggtacgggacctacggaccgtacgggtccncccggtacccgtcgtcctacttcccgtccgtacccncccgtactctaccgttcgccgttcgacgtacgngggtctacggg

SEQ ID NO: 266203 - DNA, 836 bp, Homo sapiens
  misc_feature: GYAE6OF01DDFL0.23.80.H03.1.454.CMB.1.raw
  modified_base (225)..(225): a, c, t, g, unknown or other
  misc_feature (225)..(225): n is a, c, g, or t
tcagacgcgagtatcacgaccggtgctcgatttagctgtgcgtcgaagggaaaggggacaatcttcatcatgacctgcctccctctcctcctccacccttctcattcactgcacgagggtcggtcgggcccagtctcattgacgcgacgccgccctctactttcgcggccggccccgaaggacgacgggccggtaccacctactttccgtcggcgtacgggaacnccaacctaccaacgtagttacgggactcgtagttcgggttcgtttccgtacggtaaccaggacctaggtacgcgacgaacgggaacctacccgacccctaacttctactacttcgtttagaactaacgttaactaaacgtctactacgtacggtacctccgtacgtacctctttccgtcgtaccgtacctacgtacgtcgtacggctacgtacgaccgacccaaccgtagaccacgtaccgaccgtacgtaccgaaggtaccgggacggggaaccgacggtaaccgtattacggttaccgagggaacggtaacgtagggttaacggaacttaacgaaccggtccgtaagggacgggttcggggtacggttacgggggttcggttaccgggggaaaccgggtaacgggtaaccctaaacggggttcccggtaaccggtttacggggacccgggtaacaaacccgggtaccggtacccggtacccggtccccggtaccccggtttccggtaccttttaacccgggtttcccgtcccccgtaccctttacccgtaactaccggttcccgttaccggtcggtacgtaggggccggtccggggcggttaacccggg

SEQ ID NO: 266204 - DNA, 735 bp, Homo sapiens
  misc_feature: GYAE6OF01C91M3.23.80.H03.1.454.CMB.1.raw
  modified_base (195)..(195): a, c, t, g, unknown or other
  misc_feature (195)..(195): n is a, c, g, or t
  modified_base (425)..(425): a, c, t, g, unknown or other
  misc_feature (425)..(425): n is a, c, g, or t
tcagacgcgagtatcacgaccggtgctcgatttagctgtgcgtcgaaaggggaaagggggagagaggagccttagccctggattccaaggcctatccacttggtgatcagcactgagcaccgaggcttcaccagtggaacgtggggctccgcgttgggttttccttgtcgcttatttagaagctgtccagtgtgnggtgcaggtggtggagtcggtgggggacgccgtggtcgagggccggtggggacgtcctggaacgtactttccagtacactccttctagtaacttcgtacttccttactacgtacggtaacgtcggggtccgacgacggcctaccggtaaggggtaacgggttcgtaagggcggttcgggtcctccgtaccagtcgtaacgtacgaatcgtaagtttaacgttttaaagtntttaggtgggttcgggtacgtaggtaggaacgggtcctcttaccacgtactctacgacggaacaaccgaccgacgaagaactacacgtagtatctacgtaactaacgtcgaacctacgccgtaagaggaacgtcgggaacggaacggtacgggttagtaagtttacgtacggttgttaggtaggaaggaacgggaagacgggaaggtacgggaacgggttacccggtaccgggccggaacccgtacccggggtaacccccgggtacgttaccccgggtccggtttaccgtccggtttccccgtaacccgg

SEQ ID NO: 266205 - DNA, 737 bp, Homo sapiens
  misc_feature: GYAE6OF01DWMLA.23.80.H03.1.454.CMB.1.raw
  modified_base (207)..(207): a, c, t, g, unknown or other
  misc_feature (207)..(207): n is a, c, g, or t
  modified_base (689)..(689): a, c, t, g, unknown or other
  misc_feature (689)..(689): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattggacgcacgcccgcccttcacttttctgccggcccaggacagggcgtcacctatttcctgcgtcgggaancacctccaacgtattcgggactcagtggttctttacctggtaccagcagtatcgcaggaacacgccccctaattcactattctttacgactagtaactaaaacgtccttctacacggttacctcgtacgaccgtctttcctctcggctacctaaaggttctcgtacgaccggttaccacggaccctaccggtacggaacctaccgttacccggacccggtacgttcccgaacgggtccgggttaacggggaaccggtacgggttacccgttaaagtttaccgttacgtacggaacccgggtaaacgtaacggttacggggaaactaaccgtaacgtcccgttacggaacgggttggtccggttggggttccggttacgggacgggtaacgggaaccctaacggtcgtaccggtacggtcgggtacgaccgaccggtacggtctcccgccccggttgtccctacgttcccgtccggtaccccncccttccgactaccgtccgtcgtaccgtgttacggcggtgggtaccgg

SEQ ID NO: 266206 - DNA, 586 bp, Homo sapiens
  misc_feature: GYAE6OF01A0VKN.23.80.H03.1.454.CMB.1.raw
  modified_base (405)..(405): a, c, t, g, unknown or other
  misc_feature (405)..(405): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagccacctccaacattgggactcatggtgtttcctggtaccagcagatcgcaggaacacgccccccaacttctcatctttgactagttataaacgactctcaggtactcctgaccgcttctctggctccaagtctggcacgtcacgcccaccgtgaccataccaccggtactccgagacgtcggggacgacggcgtatttacgtacnggtacggaatagtagggactaacgaagtcctagacgtggtcgtaggggtcgtacgggacggacggaaccaacgtcggaccgtccggtcgggtcgacgcccgaacgcgtccgccccgtcggtccacctcgtcccgtcccacccttcctccacttaccgtccgcgtcctcggcggtcggtcgg

SEQ ID NO: 266207 - DNA, 688 bp, Homo sapiens
  misc_feature: GYAE6OF01BDLKJ.23.80.H03.1.454.CMB.1.raw
  modified_base (290)..(290): a, c, t, g, unknown or other
  misc_feature (290)..(290): n is a, c, g, or t
tcagacgcgagtatcacgaccggtgctcgatttagctgtgcgtcgaaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaaccacgccccccaattctcattctttgactagttaanaaacgctctcgaggtacctctcgaccgtcttctctggctaccagtctggcacgtcacgccaccgtggactactccgaccggactccgagtaccgtgggggacgacggccgtatttacgtactggacgtaacgagtgggaactacaacgtctacgaggtggtacgttggggtacgttcgggacgggtaacggaaccccgtaagtccggtacccgttccggtaggggtaccaaccgggtacccgaaacggggtcccttccccgggaccccccgttagggtaccccgtaaccgtttcccggttacccggtttaccccccctacccccggttacccgttacctaaaccgttaccccggttcgtaccccggtttactcggggtaccggtcccggggtacccgg

SEQ ID NO: 266208 - DNA, 689 bp, Homo sapiens
  misc_feature: GYAE6OF01AWUKL.23.80.H03.1.454.CMB.1.raw
  modified_base (152)..(152): a, c, t, g, unknown or other
  misc_feature (152)..(152): n is a, c, g, or t
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (446)..(446): a, c, t, g, unknown or other
  misc_feature (446)..(446): n is a, c, g, or t
  modified_base (484)..(484): a, c, t, g, unknown or other
  misc_feature (484)..(484): n is a, c, g, or t
  modified_base (531)..(531): a, c, t, g, unknown or other
  misc_feature (531)..(531): n is a, c, g, or t
tcagacgcgagtatcacgaccggtgctcgatttagctgtgcgtcgaagggaaagggacgaatcttcatcatgacctcgctccctctcctcctccaccttcctcacttctactcgcacacgggtcgtcgggccacgtcgtacctagttcgacnccacgcccgtccttctacttctcgccggacccaggacnggccgtcacctcttctcgcgtcggacnccncctcgaacncgttcgggactacngttcggtcgtttcaacggtacncggacacgacgttccgacgaaggaacctccgaccccctaacttcgtccntttacggtttcaactagttaacgaacggtacctgttaaccaggttacctaccgtcgcccgttatttcgaccgtcggttaaccaccgtaagtccgtacggcgttaacccgtaaccggaccctccgtacggacnccttacggaaccggtctcctaaggacccggtcgggganacggtactaggtttacacgttcgacgatacgtgaactcgtagcctangtcgcgttagggtcgtcggacggaactaccgacgtacgtccggtccgtagggtacaccggtcaccggtcgtaccggtcccgcggtcctcggtaccgttccggacccgttcttaaccggcgtaactccggtatcccgagttcggtccggagttcccggg

SEQ ID NO: 266209 - DNA, 821 bp, Homo sapiens
  misc_feature: GYAE6OF01EFG32.23.80.H03.1.454.CMB.1.raw
  modified_base (228)..(228): a, c, t, g, unknown or other
  misc_feature (228)..(228): n is a, c, g, or t
  modified_base (337)..(337): a, c, t, g, unknown or other
  misc_feature (337)..(337): n is a, c, g, or t
  modified_base (813)..(813): a, c, t, g, unknown or other
  misc_feature (813)..(813): n is a, c, g, or t
tcagacgcgagtatcacgaccggtgctcgatttagctgtgcgtcgaaagggaaaggggacaatcttcatcatgacctgcctcccctctcctcctccacccttctcattcactgcacgagggtcgtcgggccagtctccattgacgcacgcccgccctctactttcgtcggcccggaccccgaaggacagggccggtaccacctatttcccgtgccgtaccggggaacncctacccgtacccaaactagttcgggacctcgtagttggttcgtttccgtacgggtaccagcgtaacgacgtccggacgaacgggaacccaccgacccccctaattccnctacttcttacgaacttagttaactaaacgctctacgtacgtacctccgtacgacccgtcttcgtcgtcgtacctaccgtaagttccgtacggtacctaccgtacgaccgtaccccgtaaccgtacggaaccctacgtacccggaacccggtacctacggaacgggtacggtacggggaccgaacggtaccgttaagtttaacgtacgtacgaaccggtaaacgtacggttaacgggaacctaacggtaaccgtcgtacggtacgggttagggcgggtttacggggtaggtcccggggaacgggtaaaccggaaccgttaacggaccggttacccggtaccggtaggggttaccaccgggaccctacggtcccgtacccggtccccgttacggccctaaccgttcccggtacccgtttaccccaccccgttctaccgttaacgtaccgttcccggacgttcccgtagggtcccggngggtaccg

SEQ ID NO: 266210 - DNA, 868 bp, Homo sapiens
  misc_feature: GYAE6OF01EL163.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgcttgggttttccttgtcgcttattttagaagtctgtccagtgtgaggtgcgaggtggtggagtcgtgggggacgccgtggtcaggccgtggggactcccgtagagtaactttcctgtactactcctctagtaattccaacgttccttaactaccgtacggtaaccgtcggggtcccgaccgaacggtccgtacccggaagggggtaaccgggtcccgttaagggtacggggtttccggggttcccgttaccggtacccgtaacgttacccggtaacgggttacccggaaaacggtaccgtttaaagggttttaaaaggtttttaaaaacgttaagttttaaggtggggttacgggggtaccaagggtttacgggaaaccgggtcccgttaccttaccgaaccctacgtcccgtaccaggaaccgtaacgaacccggaccgtaaacgaaacttacgtaacgttagttacctacgtagaaccgtaaagttccggaaccctacgtacccggtaggaaacgtaaccgggacgggtaacggaacggtacggggttaactacgtttaagttacggttggtacggtaaggaagggtacgggtaaaggaccggtaaagggtacgggtaaacggtaccgggttcccgggacccgacccgggtaacccggggtacccccgggttaaccgtccgggttaacccccgtccggtttacccgtcccgttaacccg

SEQ ID NO: 266211 - DNA, 825 bp, Homo sapiens
  misc_feature: GYAE6OF01B6D1V.23.80.H03.1.454.CMB.1.raw
  modified_base (736)..(736): a, c, t, g, unknown or other
  misc_feature (736)..(736): n is a, c, g, or t
tcagacgcgagtatcacgaccggtgctcgatttagctgtgcgtcgaagggaaaggggacaatcttcatcatgacctgctcccctctcctcctcacccttatcattcactgcacagggtcgtgggcccagtctccattgacgcagcccgccctcacttttctggccggccccaggacaggcgtcacctatttcctgcgtcgggaacgccaccctccaacagttcggggactcagttcggtcgttttccgaggttacccagccaagacgttcgacgaacgggtaccaccggacccccccaaacttttcctactacttaccgttttacgaaccttaaggtttaaaccgttaaaaccggaccttacctacgtaacgggtttacccttacccggttacggaccccggttccttttccgtaccgttacgggtacccttaccctaaacggttccggttcgggtacctaacccgggttccaaccggcccgtaaccccgttaggaaccctaaaccgttcccgaacccgggtaccctacccgtaacggtaccgggttacggggaaccggtaacgggcccgttaaagttttacgttaccgtacgggtaaccggaaccgtaaggtacgggtaacctaaacgtacgtccctaggtacgggtcggtcggttggggttcggttcgggaccgggtaacggaacctaacggtcgacccggttcggaggtccgacgaccggacgtccgtacccncccgggtcgtcctaccgttccgtccccgttccccgtcccttaccgcttaccgtacccgttccggcttccggcggacggtccggtaccgg

SEQ ID NO: 266212 - DNA, 810 bp, Homo sapiens
  misc_feature: GYAE6OF01BB0TQ.23.80.H03.1.454.CMB.1.raw
  modified_base (149)..(149): a, c, t, g, unknown or other
  misc_feature (149)..(149): n is a, c, g, or t
  modified_base (261)..(261): a, c, t, g, unknown or other
  misc_feature (261)..(261): n is a, c, g, or t
tcagacgcgagtatcacgaccggtgctcgatttagctgtgcgtcggaaggggaaagggggagagaggagccttagccctggattccaaggcctatccacttggtgatcagcactgagcaccgaggcttcaccatggaactgggctccgnttgggttttcctgtcgctattttagagctgtccagtgtgaggtgcgagggtggtggacgtcgtggggggacgccgtggtcgaggccgtggggactcccgtgagtactttccngtacactcctctagtaatttccacggttcctttaacgtaccgttacgggaaaccgttcggggtacccaccgtaagggtccctaccggtaagggggaacgggtccctagggtacggttcggggttccttccggtacctagttaccgtaaggtacccgtaaaggcctaaagggttttaaacgttttaaaaagttgtttaacgtggggttaggggttaccaagggttagggaaccggggtcccttccttaccgaaccctattcccgtaccgaagtaacggaaccctaaccggaccgtaaagaaccttaacgacttgtaactacgtacgaaacctaagtccgaacctagtaccgtaggaacgaacggtccggaaggtacccggttaagggttacgtttaagttaaccggtttaggtacgggttagggtaacgtagggaaccgggtaagtaaccggaaaggggtagtacgggttccgggtacccggcccggtaaccggacccggggtaaccccgggtaccctcgggtaaccctcccgttcccgtaccgtacccg

SEQ ID NO: 266213 - DNA, 765 bp, Homo sapiens
  misc_feature: GYAE6OF01EZPCG.23.80.H03.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (239)..(239): a, c, t, g, unknown or other
  misc_feature (239)..(239): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagcccgccctcactttctgccggccccaggacaggcggtcacctatttccngcgtcgggaanccacctccaanagttgggactcatggttgtttccnggtaccagcagctacgcaaggaaccacgccccccaaacttctcattctttgacagttaataaacgactctcgagtactcctgaccgtcttctctggtctcaacgtctggacacgtcacgtcccaccgtcggactactccgacccgaccgtccgaagtacgtaggggtaaccgacggtaccgtaagttaagttaccgtcgggtaaccggaactacggttaggggaacttaaaccgaacggtcccgtacgacgggttcgggcggttggggttacgggttccgggggacgggtaaccgggaaccgtaaaacgtccgggtaaccccggttccgggtcggggtacccgaccggtacccgaaacgggtcccgttaaccccggcccccgttccgggttacccgtaaccccgttttaccggttccccgtttaccccccgtaacccccgttccccgttaacccgtaaccgtttaacccccggttccgggtacccggttacccgttacgggtaccggggtacccgggggttccggg

SEQ ID NO: 266214 - DNA, 763 bp, Homo sapiens
  misc_feature: GYAE6OF01AZAAO.23.80.H03.1.454.CMB.1.raw
  modified_base (161)..(161): a, c, t, g, unknown or other
  misc_feature (161)..(161): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattggacgcagccgccctcacttttcnggcggccccaggacaggcgtcaccatttcctgcgtcgggaancacctccaacngttgggactcattggttcgtttccgtcggtaccagcagctcgcaacggaacacgcccccaacttctcatctttcgactacgttaactaaacgtacgttctacgtacggtaccttcccgtacgtacccgtcctttccttccgtcggtcctaccgtaacgttccgtaggtcctacgtccacgccctacccgtcggaaccactaccgacccggtacctaccgaacgacggtcggggaacgacggaccgtaatttaccgttaacgtcggaacggtaacgtaggtcggaactaaacgacgtccgtacgtacggtggtacggttcgggttcggtaccggggacggaacgggtaaccgtaacggtccggtacccggtaccggtttcgggacgaccggacccggtaacggtcccgttacccgcccccgttcggttacccgtacccgttacccgttccccgggtttaccccccaaccccgtttcccgttaaacccgtacccgttaccccgttacccggtacccgttcggttacgggccgggttcccggggttacccgg

SEQ ID NO: 266215 - DNA, 916 bp, Homo sapiens
  misc_feature: GYAE6OF01D4PGV.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacgagggtcgtgggcccagtctccattgacgcacgccgccctctacttttctcgccggccccaggacaggcggtcacctatttcctgcgtcgggacgccacctaccaactagttcgggactcgagttgggttacttttccgtacggtaccaggaccaagtacgtccggacgaacggaaccgacccgacccccctaacttcctactacttccgtttagaactaacgtttaacaaaccgtaccttccgtacgacggttacctccgtacgtaccgtccttcctacgtcggtccttaccgtaagttccgtacgaccgtacgtaccgaccgacccgtaccgtacgggaacctaccgtacccggtaacccggtaacccttacccggaacgggtacccgggtacgggggaaccggtaccgggtacccgtttaaacgttaaccgtttaccggtacgggtaaaccggtaacgtacgggtaacgggtaaccttaaacggaaccgttccgtacggtacgggttcggggtttaccgggttcgggggtttacgggtaccgggggaacgggtaacccgggtaaaccgtaaaccgggttcccgggtaacccggttccgggttacggggtacccgaaccgggtaacccgtaaccgggtcccgttacccccggttacccccggtacggtacccttaacccggtttcccccggttaccccggttccccccttacccggttccccctaaccgttacccggttacccccgttacccgggttacccggttccgggttacccgggtaccgggttccccgggtccggg

SEQ ID NO: 266216 - DNA, 618 bp, Homo sapiens
  misc_feature: GYAE6OF01DX4AJ.23.80.H03.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
  modified_base (276)..(276): a, c, t, g, unknown or other
  misc_feature (276)..(276): n is a, c, g, or t
tcagacgcgagtatcacgaccggtgctcgatttagctgtgcgtcgaagggaaaggggacaatcttcatcatgacctgctcccctctcctcctcacccttatcattcactgcacagggtcgtgggcccagtctccattgacgcagccgccctcactttctgcggccccaggacaggcggtcaccatttcctgctcgggaancacctcaacattgggactcatggtgtttccnggtaccagcagatcgcaggaacacgccccccaattctcatctttnactagttataaacgactctcaggtactcctgaccgtcttctctcggctccaagtctggccacgtcacgcccacctggacactccgaccggactccgaagacgtagggggacacgggccgtaatttagtaccgtaggaccggaactagtacggggataacgaagcctgagtggcgttggggtcgttcggggacggtacgggaaccaacggtcggacccgtcggtcgggtacacggacccaaggcctaccggcccccgttaggcctacgttccgtcccgttaccccacccgttccctacgtaccgttaccgtccggtacgttccgtcggaccggcgggtaccgg

SEQ ID NO: 266217 - DNA, 1055 bp, Homo sapiens
  misc_feature: GYAE6OF01B6XKF.23.80.H03.1.454.CMB.1.raw
  modified_base (208)..(208): a, c, t, g, unknown or other
  misc_feature (208)..(208): n is a, c, g, or t
tcagacgcgagtatcacgaccggtgctcgatttagctgtgcgtcgaagggaaaggggacaatcttcatcatgacctgctccctctcctcctcaccttctcattcactgcacgacgggtcgtcgggccagtctccattgacgcagcccgcctctactttctcggccggccccaggacgaggcggtcacctatttcctgtcgtcgggaancctacctccaacacgtttacggggaccttaccgagttcggtttcgttttacccgacggttaaccaacggtcaacggacgtccggacgaacgggtaaacccacccggtacccccctaaacttttacctacctaacgtttaccgttttacgaaccgttaacggtttttaaaaccaaaaaccggttccttaccgttaccggtaaccgggtttaaccttaccccgttacgggaaccccggttcccttccggttaccgtaccggtacccgtaaccgttaaccggttccgtacggggtcctaaccggtaccgtaaccggacccctaacccgtcgggtaaactaccgtacccgtaaccccggtaccttaccggaacgggtaaccggggtaccgggggtaacggtaaccgggtaaccgttttaacggtttaaccgtttacccgggtacgggtaacccgggtaaacggttaacgggtaacggggttaaacctaaaaccggtaacgtaccggttacccggtaagggtttccggggtacgggtttaccgggggttacggggttccgggggtaacccgggttaccggggtaaccgggtaacgggttccccggttaccgggtaccccgtttacgggttaccggacggtttaaccccgaaccgggttacccgtaaaccgggtccccgttaaccccgggttcccccggtaaccggttttacccgtcccggttacccccggtttaccccgggttaacccccccgtttccccggttaaccccgttttaccccgggtaaccggttttaccccgtaacccgggtttcccgggtaaccccgggtttcgggggtaaacccccgggggg

SEQ ID NO: 266218 - DNA, 827 bp, Homo sapiens
  misc_feature: GYAE6OF01BO1GQ.23.80.H03.1.454.CMB.1.raw
  modified_base (152)..(152): a, c, t, g, unknown or other
  misc_feature (152)..(152): n is a, c, g, or t
  modified_base (157)..(157): a, c, t, g, unknown or other
  misc_feature (157)..(157): n is a, c, g, or t
  modified_base (166)..(166): a, c, t, g, unknown or other
  misc_feature (166)..(166): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
  modified_base (463)..(463): a, c, t, g, unknown or other
  misc_feature (463)..(463): n is a, c, g, or t
tcagacgcgagtatcacgaccggtgctcgatttagctgtgcgtcgaagggaaagggacaatcttcatcatgacctgctcccctctcctcctcacccttctcattcactgcacgagggtcgtgggcccaggtcctccagttcgacgcagcccnccctntacttttcngccggacccaggacctaggcgtcacctatttccagcgtacgggaancacctccaaangttggactcagtggtcgtttccgaggtaccagcgaagtacgtcgacaaggaacctaccgtacccccctaaatttcacctaatttaccgtttagaaccgtaagtttaaactaaaaccggtccttacgtaccgtaacggtaaccttccgtaaccggtacccgtctttacctccggttacggacccttaacgtaaaccggttccgtcggtaccctacggtaccaaccgtacccgttaacccgngggtaacccacgttaccgaacccgggtactaccgtaacgggaacggtcggggaaccgacggttaccgtaagtttaaccgttacgtacgggaaccgtaacgtaggtacggggtaacaaacggtaacgtcccgtaaggtacggtacggggttaccgttggggttacggttccggggaacgggaacggtaacccgtaaacgtccggaaccggttcggtacgggtacaccgggtaccgtaacggtccttacccgggacccttcgggaccctaaccgtttccgtaaccccggtttccccaccctttaccaccgttaaccgtaccccgtacggttaccctagggtcccggaacgggttcccgggtaaccg

SEQ ID NO: 266219 - DNA, 907 bp, Homo sapiens
  misc_feature: GYAE6OF01AX0OA.23.80.H03.1.454.CMB.1.raw
tcagacgcgagtatcacgaccggtgctcgatttagctgtgcgtcgaagggaaagggacaatcttcatcatgacctgcctcccctctcctcctcacccttctctattcactgcacgagggtcgtcggcccagtctccattcgacgcacgcccgccctctactttcgtcgcccggccccaggacgacggtccggtacacctatttccgcgtccgtacgggaacgccaacctaccaaactaggttcggacctctaggttcggttccgtttccgtacggtaacccgagtaccgtaagaacgtccggacgtaaacggaacccgaccccgtaccccctaacgtttcctacgtacttacgttacgtaactaacgttaacgaaaccgtctactacgtacgttacctccgtcgaccttcgttcctacggtcgtcctaaccgtagtcgacggtacaccgtccgaccgtacccgtaccgacggacctaaccgtccgaaccccgtactacccggaaacggtaccgggtaccggggaaacccgttacgggtaaccgttaacgtttaaccggtaccggttacgggaaacccgtaaacgggtacggtaaacggttaaccgaaacccggttaaccggtacccgttaaggaccggggttacgggttcggggttcggggtttacccggggaacggtaacccgggggttaaacccggaacccgtttaaacgggtcccggttacccggtaccggggttaccgggaaacctacccggggtctaaccccgggtcccgtcccggtaacccccgttggtaaacccccgttgtttccccggcccccgttacccctacccggttccaacccgttccccggtttacgacccccgggttcttaacccggacgggtttccgggaccccgtaggggg

SEQ ID NO: 266220 - DNA, 893 bp, Homo sapiens
  misc_feature: GYAE6OF01AO1V1.23.80.H03.1.454.CMB.1.raw
tcagacgcgagtatcacgaccggtgctcgatttagctgtgcgtcgaagggaaaggggacaatcttcatcatgacctgctccctctcctcctcacccttctcattcactgcacagggtcgtgggccagtctccattgacgcagccgccctcactttctgcgcccaggacaggcggtcaccactttcctgtcgtcgggaagcacctccaacagtttcgggactcgtaagttcggtcgttttccgtcgggttaaccagtacctagagttccggacgaacgggtaaaccgaccggaccccccctaaacctttacccgttccaacctttacctttacggtaaccgttaacgttttaaacgttaaaaaccggtaaccttaccttaccggtaaacgggtttaaccccgttacccgttaccggtaaccccggttccttttaccgttccgttcgggtacccttacccgtaaacggttccgttccgggacctaaccggtcgtaccggtaccctaaccccgtacggggtaaccctacggtacccgtacccgggtaacctccggaacgtaccggttacgggggaaccggtacgggtaccgtaacgtttaccgttaacgttcggaacccgggtaaagtcggtaacgggtaactaaccgtaaacgtcccgttaggtaccggttggaccggttcgggttacgggttacgggtccgggaacggtaacccgtaacgttaccgggccgttacccggtacgggtaccgtaccgacccggtaacggccgtacccggtcccccttggtacccgtccgttaacggttcccgttaccccgtaaccccggttcccttaaccctaccggtaacccgttcccgggtactttcccggacggtaccgggtcggtacccggg

SEQ ID NO: 266221 - DNA, 858 bp, Homo sapiens
  misc_feature: GYAE6OF01DHUL1.23.80.H03.1.454.CMB.1.raw
  modified_base (841)..(841): a, c, t, g, unknown or other
  misc_feature (841)..(841): n is a, c, g, or t
tcagacgcgagtatcacgaccggtgctcgatttagctgtgcgtcgaaagggaaagggggagagaggagccttacgccctggattcccaaggcctatcccacttggtgatcagcactgagccaccgaggcttcaccagtcggaacgtggggcctccgtcgttcgggttttccttgtcgtcttaatttagaagtctcgtcagtgtggaggtgcgtaggggtggtgggtacggtcgggtgggggggacgtccgttcgggtcgacgggtcccggtagggggtaccgtccctaggtaacgtaacttttcctagtaacctcttcctctagttaacttccgtaacgttccttaacgtaaccgtacgggtaaccgtccggggtcccgccgtacggcctaccggggaaggggtaaccggggtaccgtaagggtcggggtttcggtcccgttccggttacccagttacgtaggtaaacccggaagtacgtaaaggttttaaaagttttaaaacggttagtttaaggttggggttacgggtacgtaagggttacggggaacgggttcccctacttaccgacccgtcttacccaccgaaacggtaaccgaaacccgaacccggttacccgaaagtaaacctacggtaacttacgttaacgttaccgaacgaaacttaaacgccgaaaccgtaccggtaccggaaggaacggaaacgtccgggaaccgggtaacgttaacgggggtttactttaacgttaacgtttggtaggttagggagtaacggggagtaacgagggtaggaacggttagggtcccgggtacgcccggacccggacccggtcccgtacgtcnccgtactcgtcccgtac

SEQ ID NO: 266222 - DNA, 1051 bp, Homo sapiens
  misc_feature: GYAE6OF01ACNUB.23.80.H03.1.454.CMB.1.raw
  modified_base (230)..(230): a, c, t, g, unknown or other
  misc_feature (230)..(230): n is a, c, g, or t
tcagacgcgagtatcacgaccggtgctcgatttagctgtgcgtcgaaagggaaaggggacaatcttcatcatgacctgcctcccctctccctcctccaccctttctctattcactcgcacgaggggttcggtcgggccctagtcctcctagttggacgccacgcccgacccttctcttttcgcggcccgacccgaaggacgacgggccgtaccaacttaccgttttccgngtaccgtacgggagacctacccctacgacgtagttcggacctcgtacgttcgggttcgttttaccgacggtaaccacgacgtacgtaacgtccggacgaaccggaacccaaccccgttaacccccgtaccttccttatccgtttacgtcgtaacgttaacgttaactaaaccggtaccttccgtacggtaaccggtttacccttaccggttacccggtcctttaccgttaccgttccggtaccgttacctaacccgtaggtccgtacgtacccgtaccgaccgtacccggtaccccgttaccggtaccggtaaaccgttacccgtacccggaacccggttaccccgtaacgggtttacccgggggacgggggttaaccggggtaaacccggtacgggtttaaccgttaacgttttaccgggttaaccgttacggggtaaaccggaaccggtaacgggtttaaaccggtaacggttaaacccgtaacggttaccccgttaacgggtaccggggtttaccggggttacggggtttaccgggggttttacccggggtaaccgggggttaacccggggaaaacccggttaaacccggtaaccccgggtttaccgggttaccccggggtttccggtaaccggggtaacgttacccccgggacggttaccccgggttacccggttcccccgggtaccccggttcccgttacccgggtaccctttccccgtttaaccccggttaccccgtcccccttccggacccttaacccggtttcccggtcccggttacggtaccggtacggggccgggtaccgggttacccggg

SEQ ID NO: 266223 - DNA, 983 bp, Homo sapiens
  misc_feature: GYAE6OF01EA7JA.23.80.H03.1.454.CMB.1.raw
  modified_base (159)..(159): a, c, t, g, unknown or other
  misc_feature (159)..(159): n is a, c, g, or t
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtaggcccagtctccattgacgcagccgccctcactttcngccggcccaggacaggcgtcactatttcngctcgggancacctcaacagttggactcagtggttcgtttccgtggtaccagccagactcgacgaggaaccaccgtacccccctaatttcctactaacgttccttttacggaacctaaggttaaactaaaaccgtacttaccgttacgtaacggttaccttccgtacgtacccgtctttccgtacgtcggtaccttaccgaacgttccgtacggtcccgtaaccgttaccaacggtaccccgtacccgtacgggtaaacctaccgtacccggtaaacccccggtaacccttacccgaaagggtacccggggtacggggggtaacccggtaaccgggttaaccccggttaaatttttaacccgggttaacccgtacggggtaaacccggtaaacgtacgggtttaacggggtaaaccttaaaccgggaaacccgttccccggttaaccggttaagggttaccggggttaccgggtttaggggggtttaccggttacccggggggaaaccgggggtaacccgggtaaacccgttaaaaccggttccccgggtaacccggttaccgggtttaccggggtaccctaacccgggaacccccgtaaggggtcccccgttacccccgggttacccccggtttaccgggtaccccgttaacccgttttccccgggtacccccggtttttccccccccgtacccccgttttacccggtaccccgttaaacccttccccggtttacccgggttcccccggttaaccgggttcggggtaacccgggggtcccgggttaacccgggg

SEQ ID NO: 266224 - DNA, 819 bp, Homo sapiens
  misc_feature: GYAE6OF01A7I9I.23.80.H03.1.454.CMB.1.raw
  modified_base (215)..(215): a, c, t, g, unknown or other
  misc_feature (215)..(215): n is a, c, g, or t
tcagacgcgagtatcacgaccggtgctcgatttagctgtgcgtcgaagggaaagggggacaatcttcgatcatgacctgcctcccctctcctcctcacccttctctattcactgcacagggtcgtcggcccagtctccgattcgacgcgacgcccgccctctactttcgcgccggcccaggacaggtccgtcacctatttcctgccgtacggacnccacctaccaactagttacgggaccttcagttcggttcttccgtagggtacccaagtccaaggtactccggacgtaacgggaaccacccggtacccccctaatttcctaccgtacttaccgtttaccgaactaacgttaactaaaccggtaccttaccgtaccgtacggttaccctcttacggtaccctctttacgtccggtacggtacctacgtaacggttccgtcggacccgtacggttccaccggtacccctaccggtacggtaacccgtacgttacccgaacccggtacctaccggaacggtacccgggtacgggaccgtaccggtaccttaacgttacgttaccgtaggtaacccggtaagtacggtacgggtaaccaaccgtacgtacccgtaggtacggtcgggttaccggtgggttacggtccgggacggtaacggtaaccgtaacgtccggtaccggtcgtaccgggtaccgtccggaccgaaggtccgtacccgtaccccgtgtcccgtaaccgttccgtacccgtacccctacccgtcgttacccgtagttcccctacgggtccttaccgaacgggtccggtccgtaaccggg

SEQ ID NO: 266225 - DNA, 821 bp, Homo sapiens
  misc_feature: GYAE6OF01AVV2V.23.80.H03.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (196)..(196): a, c, t, g, unknown or other
  misc_feature (196)..(196): n is a, c, g, or t
  modified_base (274)..(274): a, c, t, g, unknown or other
  misc_feature (274)..(274): n is a, c, g, or t
  modified_base (529)..(529): a, c, t, g, unknown or other
  misc_feature (529)..(529): n is a, c, g, or t
tcagacgcgagtatcacgaccggtgctcgatttagctgtgcgtcgaaagggaaaggggacaatcttcatcatgacctgctccctctcctcctcacccttctcattcactgcacagggtcgtcgggcccagtctccattgacgcacgccgcctcnctttcgngccggcccaggacgaggcggtacacctatttccgnggcgtacgggaacgccaccctacaacctagttggggaaccttcgaacgttcgggttcgttttacccgtcggtaaaccncggtacctaacgtaacgttccggaccggaacgggaaaacccgacccggaaccccccttaaacttaccttccgttaactttcgttttacggaaccttaaagttaaaccgtaaaaccgtcgttaccctacggtaaccgggttacctaccgttaaccggtacccgttccgtttccgtacgttaccggttccgttaacccgtaacgtcgtccggtaccgtacgttaccgaccgtacccgtaccccggtaggtaaacccnctacccggtaaccccgacgttaacccgacgtaacggggtaccgggaaccgtaacggttacgtacgttacttacggtcggtacgaacgacgttacggacgtacgacgacgttcaacggtcgggtcggtggttcggtcgggacgacggtactaacgtccggtaaccggtcgtacggtaccgcgacccgtacggacgtcccgcccgtcggaccgttccgtaccgtcctacccggtcccttaccgtcctacgttaccggccggttactaccggacggtccggttccgggtaccggg

SEQ ID NO: 266226 - DNA, 902 bp, Homo sapiens
  misc_feature: GYAE6OF01EKJRW.23.80.H03.1.454.CMB.1.raw
  modified_base (161)..(161): a, c, t, g, unknown or other
  misc_feature (161)..(161): n is a, c, g, or t
  modified_base (210)..(210): a, c, t, g, unknown or other
  misc_feature (210)..(210): n is a, c, g, or t
  modified_base (877)..(877): a, c, t, g, unknown or other
  misc_feature (877)..(877): n is a, c, g, or t
tcagacgcgagtatcacgaccggtgctcgatttagctgtgcgtcgaagggaaaggggacaatcttcatcatgacctgcctccctctcctcctcacccttctcattcactgcacgagggtcgtcgggcccagtctccattgacgcagccgcctctactttcncgccggcccaggacacggcgtcaccgtactttcctgacgtacgggaacnccaacctaccaactagttagggactcagtggttcgtttaccgtacggtaccacgcgacgacgtcgacgaacggtaaccacccgtacccccctaacgttcctactacttaccttttaacgaacgtttaactaaaaccgtactaccgtaagttaccgggtaccttacccgtacggtaccgttccgttacgtaccgttcggtaccttaaccgtaacggttccgtacggaccctaaccggtctaacccgggaccctacccgaaggtaacctaacggtacccgtaaccccgtacgtaacccgacggttaacgggtaccgggggaaccggtaaccggtaccgttaaacgtttaaccgtttaaccgtaccgggtaaaccgggaaaacgttacgggttaaacgggaaactttaccccgaaacggtcccgttaacgggtaaacgggtcgggtttaaccgggttacggggtttcgggtaacccgggggtacgggaaacccgggtaaacccgtaacgggtaccggtaacccggttaccgggttaaccgggtaccgaaccggttacccgggaaaccggtcccgttacccggtcccccggttaggtaccctacccgtttccgtacccgttcccccgtacctcccgtaccgttaaacccgtcggttcccgtaccggttacnccggggacggtccggtcggtacggg

SEQ ID NO: 266227 - DNA, 750 bp, Homo sapiens
  misc_feature: GYAE6OF01B2VXX.23.80.H03.1.454.CMB.1.raw
  modified_base (162)..(162): a, c, t, g, unknown or other
  misc_feature (162)..(162): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
tcagacgcgagtatcacgaccggtgctcgatttagctgtgcgtcgaaagggaaaggggacaatcttcatcatgacctgctcccctctcctcctcacccttctcattcactgcacagggtcgtgggcccagtctccattgacgcagcccgccctctactttcngccggccccaggacaggcgtcaccatttccngcgtcgggaanccacctccaactgttcgggactcagttggttcgtttcctggtaccagcgaagtactcgacaacggaaccaccgacccccctaacttcctctacttctttacgaactagttaactaaacgactctacgtacggtacctccgtcgaccgtcttcgtcgtacggtcctaccgtaagtcgtcggctacgtcgacgtacccaccgtagacctactaccgacccggtactaccgaggtacggtcggggaacgacggtaccgtagtttacgtaccgtcgggaacgaacgtaaggtagggtaactaaccggtaacgtccgtaccggtaggtcgggttcggtaggggtttcgggtaccgggacgggtaaccgggtaacctaaacggtccggtacccggtccgtacggggtaccgaaccggtacccgtaaccgggtcccgtaccccggtccccgttcggtaccctaccgttacccgttcccgttacccccgtacccgttccctacgtaacccgttaccgttccggtaccgttacgcgggtaccggcccgggtacgg

SEQ ID NO: 266228 - DNA, 818 bp, Homo sapiens
  misc_feature: GYAE6OF01A0KZ2.23.80.H03.1.454.CMB.1.raw
tcagacgcgagtatcacgaccggtgctcgatttagctgtgcgtcgaaggggaaaggggacaatcttcatcatgacctgctcccctctcctcctcacccttctcattcactgcacgagggtcgtcgggcccagtctccattgacgcagcccgccctctacttttcgtcgccggccccaggacgacggcggtccacctactttcctgcgtcgggaacgccaacctccaaactagtttcgggactcagttcggttcgtttaccgtcgggtaaccaagcaagactccgacgaaggaaccaccgaccccctaacttcctacctacttctttacgaactaagttaacgtaaaaccgtactacctacgtaacggttacctcctacggtaccccgtctttaccgtcggtacggaccttacccgtaaacggttccgtcggtaccgtaacgtaccgaaccgtacccgaaccccgtaacggaacaaccttaccggtaaacccggaccttaccgaacgggaaccgtacgggggaacgacgggtaccgtaactttaacgtaacgtaccggacggtaaacgtacgtagggaaactaaccgacgtacccgagtaacgggtggcgttggggtttcgtacggggaccgggaacggaaaccctaaagggtcgtacccggtacgtacgggtacaaccgggacccgtaggacccgtccgcccccgttgggtaccctaccgttacgttaccccgggttcccccaccgtttacccgtaccgtaacgttacccgggttacccgttacggtaccgttaccgggaccggtccgggtacccggg

SEQ ID NO: 266229 - DNA, 894 bp, Homo sapiens
  misc_feature: GYAE6OF01CWZ72.23.80.H03.1.454.CMB.1.raw
tcagacgcgagtatcacgaccggtgctcgatttagctgtgcgtcgaaggggaaagggggagagaggagccttagccctggattccaaggcctatccacttggtgatcagcactgagccaccgaggtcttcacataggacgtggggctccgtcgttcgggttttccttgtcgtcttaattttagaagtctgtccagtgtggaggtgcgaggtggtacggagtcggtgggggagtccgtagtccgaggccgtggggactcccgtgaacgtacgttttcctagtaccacgttcccttacgtagtaactttccgagttaccctttacgtaaccgtacgggtaaccgttcgggtcccgaccggtcggaccgtaccggaagggggtaacgggtccctaaggggtacggttccgggtcccttaccggtcccgagttaccgtaacgggtacgaacggtacgtaaaggttttaaaggttaaaacgtttactttaggttagggggttacggggtacgtaacgggttagggaacccggggttccctaccgtttaccacccgttacgtccccgtaacgaaccgggtaacgaacccaaccgggtaccgaaagtaacctaaccgtgttacgttacttacgtagaaccctaagtaccgtaccgaccgtacgtaggaacggaacggaccgggagggtaacccggtaagggtttattaacgtttacgttaacgttaggttaacgggtaggtaaagggccggtaaaggaaacgggttaggggaaacgttaccgggtaaccggggttcccgggacccggttaacccgggaaccccggggtttaacccccccgggaaggtttacccccgggtaccccgtaaaccgtttcccccgggttccttaaacccccgggg

SEQ ID NO: 266230 - DNA, 871 bp, Homo sapiens
  misc_feature: GYAE6OF01BC1GK.23.80.H03.1.454.CMB.1.raw
  modified_base (147)..(147): a, c, t, g, unknown or other
  misc_feature (147)..(147): n is a, c, g, or t
  modified_base (183)..(183): a, c, t, g, unknown or other
  misc_feature (183)..(183): n is a, c, g, or t
  modified_base (216)..(216): a, c, t, g, unknown or other
  misc_feature (216)..(216): n is a, c, g, or t
tcagacgcgagtatcacgaccggtgctcgatttagctgtgcgtcgaagggaaagggacaatcttcatcatgacctgcctcccctctcctcctcacccttctcattcactgcacgagggtcgtcgggcccagtctcctattcgacgcncgccgccctctactttcgtggccggacccaggacgnggccgtcaccgtactttccgtgcgtacgggacncctacctacgaactagttcgggactcgtagttcggttgttccgtggtaaccagtcaacggctacgacgaacggaacccacccgtaccccctaacttctacgttacttctttacgaacttaagttaactaactcctccgtacgacgttaccgtccgtacgtaccttactttccgtcgtcggtacctacgtacggttcgtacggtaccgcgtaccaccgtacccgacgtacggtacctaccgtacccggtaccgtactccggtaacggtccggggtaacggggaaccgtaccgtaccgtttacgttaacgttacggacggtaacggtaacggtaggtaacggaactaaccggtaacgtaccggtcgtaggggttacgggtcgggtttaggggtccgggttaaccgggggaccggtaaaccgggtaaccggtaaacggttccccgggtaacccgggttcgggtaccgggtaacccgacccggggtacccgttccggggaccccgttccccggtacccccggtttaccgtacccggttttacccggttccccggtttaccccggttttccccgacccctttccccgtaccgggttaaccctttcccggttcccgttacccgggttcgggacccggggtcgggcccggggtttaacccgg

SEQ ID NO: 266231 - DNA, 891 bp, Homo sapiens
  misc_feature: GYAE6OF01CIY82.23.80.H03.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagacgcgagtatcacgaccggtgctcgatttagctgtgcgtcgaagggaaagggacaatcttcatcatgacctgcctcccctctcctcctccacccttctcattcactgcacgagggtcgtacgggccctagtctccattcgacgcacgcccgccctcgtacctttcgcggccgccccaggacgcggcggtaccacctatttccnggccgtacgggaacncctacctaccgaaactcggttgggtacctacgtaggttcggttccgtttccggtaggtaccaggtaccagacgtcgacgaaccggaacctaccgtacccccctattcctctacttcgttaacgacgtacgttaaactaaccgtctacctacgtaacggtcctccgtacgtcctcgtctcgtcgtactaccgtacgtcgtccgacgtacgccgacccgtaccgaccgtacggaactacccgtacccggtaaccgacctaccggtacgggacggtaccgggggtaccgtaggtaacccgttaacgtttaacgttaccggaccggtaaacggtacgtacggtaacgggtaaactacggtaacgaccgtcgggtacgggttggtaaccgggtttcggggtacgggttaccccgggggtaaagggtaaacccgggtaacccggttaaccggttccggtaaccccggggttaccgggtttacccggaacccggggtaacccggttacccgggaaccgggtccccgttacccgggtccccggtaaccgtccccgttaaacccgggtcccgttaacccccgttcccccggtaccctttacccggtccccgttaaacggttcccccgtaccgggttacccgggttacggtcccggggaccggttcccggggtaaccgg

SEQ ID NO: 266232 - DNA, 730 bp, Homo sapiens
  misc_feature: GYAE6OF01BT6D6.23.80.H03.1.454.CMB.1.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (503)..(503): a, c, t, g, unknown or other
  misc_feature (503)..(503): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttctgcgccccaggacaggcgtcacctatttcctgctacggganccacctccaacagttgggactnagtggtcgtttccnggtaccagcagatcgcaggaccacgacccccaacttctctattcctttgaactagtttaactaaaccgtcttacctacgtacggttaccttccgtcggtacccgtcgtttccttacgtcgggtacctaccgtaacgttcgtcggacctaccggtccgaaccgccccgtacccgtacggtaaccgaccgttaccgaacccggtacctaccgaacggtaccggcggggaaccggacgggtaccttagtttacttacgtggaacccggtaanacggtacgggtaactaacgtaacgtcccgtacgtacgggttaggtcggttcggggtccggttacgggccggggtaaacggtaacccgtaaacgtccggtacccgttacgggtacgggtaccgtaccggaccccgtaaggccccgttacccgccccgttaccggtcccgtaccgtccgtccgttcccccaccgtcttacgacctcgtccgacttcgcgtcgcggtacg

SEQ ID NO: 266233 - DNA, 996 bp, Homo sapiens
  misc_feature: GYAE6OF01BB5DW.23.80.H03.1.454.CMB.1.raw
tcagacgcgagtatcacgaccggtgctcgatttagctgtgcgtcgaagggaaaggggagagaggagccttagccctggattccaaggcctatccacttggtgatcagcactgagcaccgaggcttcaccagtggaacgtgggctccgcgttgggttttccttgtcgtcttattttagaagctgtccagtgtgaggtgcgaggtggtggagtcggtgggggacgccgtggtcgaggccgttggggacgtccgtagagttaactttccgtgtactacttcctctagtaacttcagttccttaataccgtaggtaacgtcggtcccgaccgacggtccgtaccggaggggtaacggtaccgttaaggacggtcgggttacctccggtaccgtactaccgtaagtacccggaaagtaccgttaaaaggttttaaacggtttttaaaacgttacgtttaaggttcgggttaacgggggttacctaagggttacgggtaaccgggtccccgtttaccgttacccgaacccgtaacgtttccccgaaccggtaaacggaaccgaacccgtaaacccggtacccggaaacgtaaaccgtaaccttaaccggttagtttaaccgttacgtaaccgtaaaccgaaacgttcccggaaaccgtaaccggtaaccgttacgggaaacggtaaccgggaaccgggtaacgggtaaaccggggttaccgggttaaggttttaaaccttaaggttttaaccggttaggtttaacggggtagggtaaaaccggggtaaagggtaaaccgggtaaacggggtaaacggggttaaaccgggtaacgggttaaccccgggggttaccccgggaacccccggggtaaacccgggttaaacccccccccggggggttaaacccccgggtaaccccccggtttttaacccgggggtaacccccccggtttaaaccccggtttccccgggttttaaacccccgtttaacccccccgggg

SEQ ID NO: 266234 - DNA, 830 bp, Homo sapiens
  misc_feature: GYAE6OF01DCHMJ.23.80.H03.1.454.CMB.1.raw
tcagacgcgagtatcacgaccggtgctcgatttagctgtgcgtcgaagggaaaggggacaatcttcatcatgacctgctccctctcctcctcacccttctcacttcactgacacgagggtcggtcgggcccagtcctccagttcgacgccacgcccgcccttactcctttcgtcggccggaccccgaggaccagggccggtaccaccgttactttccgcggtccgaccgggaacacccaccgtaccgaaccgtaggtttacgggaactccgagtttcggttacgtttccgacggtaccgagaccaggactccggacgtaccgaacacccgtacccctaattccacgtacttcttaggacttaagttaacgtaaacgacttcgaaccgtaacggtacctaccgtacgaccgtttccgtactacggtcggaccttaaccggaacgtccgggtactaacggtacccgtaccgtaccggaaccccgtaacgtaccggaactacccggtaccggttaaacccgcccgtacgtaaacggggtccgggtaacgggggacgtaaccggtaacgttaagtttaaccgtcggtaacgggtaacccggtaagtaacggggtacaaccgttaaccggaacgtccgttaacgggacgggtcggtacgggttacggggtcggttacccgggacggaaccggaaacccggtttaacggcgtaacccggtcggtaacggccgtaccggaccgtaccggcgttaccccggacgaccgtccgtaccgttcctaccggttcccaccttgacctaccgtacgtcgacgtacgtacggtcggcggtaacgg

SEQ ID NO: 266235 - DNA, 779 bp, Homo sapiens
  misc_feature: GYAE6OF01EIQJT.23.80.H03.1.454.CMB.1.raw
  modified_base (170)..(170): a, c, t, g, unknown or other
  misc_feature (170)..(170): n is a, c, g, or t
tcagacgcgagtatcacgaccggtgctcgatttagctgtgcgtcgaagggaaaaggggacaactcttcgatcactgacctgctccctctcctcctcaccttctcattcactgcacgtagggttcgtgggcccagtctccattcgacgcacgcccgcccttctacttttcnggccggcccgaggacagggtccggtcacctacttttccgtaggccgtacggggaactcctacccgttaccaacgtagttcgggaccttccgagtttcgggttcgttttcccgttacgggtaccctaggtacctaaggtacgttcgaccgaacgggtaaaccaccggaccccccttaagtttaccttctaacgttttccgttttacgaaccgttaaggtttaaacgtaaaccgtacctttcgttaccggtacggtttacgttaccggtacggtacccgttctttccgttcggttcggtaccttacccgtaaggttccgtcggaccgtaccgtcaccgtccaccgtaggactacgtccgaccggctaccggagtaccgggagggacgacggtcctaatttacgtacgacggtacgaaacggtcgtaggaacctaacgacgtccgttagacgggtcggttcgtaggggtcgtcgggacgggtaacgaaccgtaacgtcgtaaccggtcgtacggtcgacgtcgtacgtcgaccgtcccgtgtacctcgttaccgtccgttccctctccgtacgtaccgttcgtcgttcccggtatcgggtccgtcgggtacg

SEQ ID NO: 266236 - DNA, 243 bp, Homo sapiens
  misc_feature: GYAE6OF01BMEBA.23.80.H03.1.454.CMB.1.raw
  modified_base (237)..(243): a, c, t, g, unknown or other
  misc_feature (237)..(243): n is a, c, g, or t
tcagacgcgagtatcacgaccggtgctcgatttagctgtgcgtcgaagggaaaggggagagaggagccttagccctggattccaaggcctatccattggtgatcagcactgagcaccgaggctcacatggaactgggctccgcttgggtttcctgtcgtctatttagaagctgtccagtgtgaggtgcaggtggtggagtcggtgggggcgcctgggcaggccgtggggacttccgnnnnnnn

SEQ ID NO: 266237 - DNA, 533 bp, Homo sapiens
  misc_feature: GYAE6OF02HAQ34.23.80.H03.1.454.CMB.1.raw
  modified_base (492)..(492): a, c, t, g, unknown or other
  misc_feature (492)..(492): n is a, c, g, or t
  modified_base (506)..(506): a, c, t, g, unknown or other
  misc_feature (506)..(506): n is a, c, g, or t
  modified_base (525)..(525): a, c, t, g, unknown or other
  misc_feature (525)..(525): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttctcatctttgacagttataaacgactctcaggtactcctgaccgcttctctggctccaagtctggcacgtcagccacctggacatccaccggactccagacgtggggacgaggccgatttacttacgtgacggaacagtgggaatacgaagcctcgagtggctgggtgttcgggcggaggaccaaagtgaccgtcgtgggtcagcccaaggctcgcccctggtcnctcgtcgttccccncctcctcactctcgcgtcngcgcggtc

SEQ ID NO: 266238 - DNA, 523 bp, Homo sapiens
  misc_feature: GYAE6OF02F7T3J.23.80.H03.1.454.CMB.1.raw
  modified_base (412)..(412): a, c, t, g, unknown or other
  misc_feature (412)..(412): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgactctcaggtactcctgaccgcttctctggatccaagtctggcacgtcagccacctggacatcaccggactccagactggggacgaggccgattattactgcggaacagtgggatacaagcctnagtggctggggtgttcgggcggaggaccaaagtcgaccgtctgggtcagcccaaggcctcgcccctggtcacgtcgtcgttcccgccctctcatctcgcgtcngngcggtc

SEQ ID NO: 266239 - DNA, 516 bp, Homo sapiens
  misc_feature: GYAE6OF02INCGA.23.80.H03.1.454.CMB.1.raw
  modified_base (508)..(508): a, c, t, g, unknown or other
  misc_feature (508)..(508): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgctctcaggtactcctgaccgcttctctggctccaagtctggcacgtcagccacctggacatcaccggactccagactggggacaggccgattatactgcggaacagtgggatacaagcctcgagtgctgggtgttcggcggaggaccaacgtgaccgtcgtgggtcagcccaaggctcgcccctggtcactcgtcgtcccacctcctcactactcgctcngacgcggc

SEQ ID NO: 266240 - DNA, 546 bp, Homo sapiens
  misc_feature: GYAE6OF02JA5MB.23.80.H03.1.454.CMB.1.raw
  modified_base (535)..(535): a, c, t, g, unknown or other
  misc_feature (535)..(535): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaacttctcatcttgacagttataaacgactctcaggtactcctgaccgcttctctggctccaagtctggcacgtcagccaccctggacatccaccggactccagactggggacgaggccgattattactgacggaacagtgggatacaagcctacgagtggctgggtgttcgggcggagggaccaagtcggaccgtcgtgggtcacgcccgaaggcctccgcccctggtccacgttccgtcgttccccaccctcctcactaccgtcgccgttcncggacggcggc

SEQ ID NO: 266241 - DNA, 599 bp, Homo sapiens
  misc_feature: GYAE6OF02GWQ69.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagccccccaattctcatctttgacagttataaacgactctcaggtactcctgaccgcttctctggctccaagtctggcacgtcagcccaccctggacatccaccggactccgagacgtgggggacgaggcccgtaatttacttacgtggacggaaacagtggggaatacgaagcctcagtggcgtggggtcgttcgggcggaggaccaaacgtcggaccgtcgtgggtcacggcccgaaggcctacgccccccgtggtccaccgttccgttccggtttcccccgccccttcccgtccgtaacgttacccgttccggtcccgttccgtcggaccggtccgggtccg

SEQ ID NO: 266242 - DNA, 522 bp, Homo sapiens
  misc_feature: GYAE6OF02GIMBF.23.80.H03.1.454.CMB.1.raw
  modified_base (513)..(513): a, c, t, g, unknown or other
  misc_feature (513)..(513): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggacagcccccaattctcatctttgacagttataaacgactctcaggtactcctgaccgcttctctggctccaagtctggcacgtcacgccaccctggacatccaccggactccagactggggacgaggccgattatactgcggaacagtgggatacgaagcctcgagtggctgggtgttcggcggagggaccaacgtcgaccgtcgtgggtcacgccaaggctcgcccctggtcacgtctcgtcccgcctctcatctcgctcngagcggtcg

SEQ ID NO: 266243 - DNA, 538 bp, Homo sapiens
  misc_feature: GYAE6OF02F0VQN.23.80.H03.1.454.CMB.1.raw
  modified_base (525)..(525): a, c, t, g, unknown or other
  misc_feature (525)..(525): n is a, c, g, or t
  modified_base (534)..(534): a, c, t, g, unknown or other
  misc_feature (534)..(534): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacagtcggtcaccatttcctgctcgggaagcacctccaacattgggactcatggtgtttcctggtaccagcagatcgcaggaacagcccccaacttctcatctttgacagttataaacgctctcaggtactcctgaccgcttctctggctccaagtctggcacgtcagcccaccctggacatcaccggactccagacgtggggacgaggccgattatactgacggaacagtgggatacgaagcctcgagtggctgggttgttcggcggaggaccaaacgtgaccgtcgtagggttacgcccgaaggcctcgcccctggtccactctcgttcccacctcctcactacctcgcgtcnggacgcggntcgg

SEQ ID NO: 266244 - DNA, 541 bp, Homo sapiens
  misc_feature: GYAE6OF02IO1QM.23.80.H03.1.454.CMB.1.raw
  modified_base (493)..(493): a, c, t, g, unknown or other
  misc_feature (493)..(493): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttctcatctttgacagttataaacgactctcaggtactcctgaccgcttctctggctccaagtctggcacgtcacgccaccctggacatcaccggactccagacgtggggacgaggccgtattacttactggacggaaacagtgggatacgaagcctcagtggctgggtgttcggcgggaggaccaaacgtggaccgttcgtgggtcagcccaaggctcgcccctggcnctcgtcgttcccgccctctacacttacgtcgcgtctggacggcggtcg

SEQ ID NO: 266245 - DNA, 553 bp, Homo sapiens
  misc_feature: GYAE6OF02F2G1W.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaacttctcatctttgacagttataaacgctctcaggtactcctgaccgcttctctggctccaagtctggcacgtcacgccaccgtggacatcaccggactccagactggggacgaggccgattatactgcggaacagtgggatacgaagcctgagtggctgggtcgttcggcggaggaccaaacgtcggaccgttccgtgggtcacgcccgaaggctccgccccgtggtcaccgtccgttcggtccccacccgttcctactactacctccggtctcgtcggacggccggtcg

SEQ ID NO: 266246 - DNA, 537 bp, Homo sapiens
  misc_feature: GYAE6OF02G2U2R.23.80.H03.1.454.CMB.1.raw
  modified_base (384)..(384): a, c, t, g, unknown or other
  misc_feature (384)..(384): n is a, c, g, or t
  modified_base (475)..(475): a, c, t, g, unknown or other
  misc_feature (475)..(475): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtctggggggaggcctgggtcaggcctgggggagtccctgagaatttcctgtacatcctctgaattcagtccttatacctggaactgggtccgccaggctccagggaaggcctagagtgggtctcgtccatcagtcgaagcagtagtttaaagtattatgtggggtcagtggaagggccncttcaccatcctccagagacaacgccgagaatacactgtatctgcaaatgaccagcctagagagcgaggacacgggtgtatattactgtgngagagagacgaggagaggagttcggccgcgacggccccgggacctggtccaccgtctcgtcg

SEQ ID NO: 266247 - DNA, 611 bp, Homo sapiens
  misc_feature: GYAE6OF02I3C6T.23.80.H03.1.454.CMB.1.raw
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcattctttgacagttataaacgactctcaggtactcctgaccgcttctctggctccaagtctggcacgtcagccaccctggaccatccaccggactccagacgtggggacgaggccgtattacttacnggacggaacngtgggaatacgaagcctacgaggtggctggggttcgttcgggcgggaacgggaacccaaacgtcggtaacccgtccgtacggggtccaacggaccccgaaagggccctccggaccccccgtgggtcctaccgttccgtccgtttacccccacccgttccctactacgttaccctccggtaccgttccgtcggacggtccgggtacg

SEQ ID NO: 266248 - DNA, 607 bp, Homo sapiens
  misc_feature: GYAE6OF02H6U6A.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagccccccaattctcatctttgacagttataaacgactctcaggtactcctgaccgcttctctggctccaagtctggcacgtcacgccaccctggacatccaccggactccagactggggaccaggccgtaattattacgtggacggtaaacagtgggaatacgaaacgcctacgaggtcggcgttggggtacggtttccgggacgggaacgggaacccaaacgtcggaacccgttccgtaggggtccaacggacccgaaggcctaccggcccccgttcggtaccacccttcgttcggttcccccaccccttcccttcacttaccgtcggccgttcgtcggtacggcggtccg

SEQ ID NO: 266249 - DNA, 568 bp, Homo sapiens
  misc_feature: GYAE6OF02IHLYS.23.80.H03.1.454.CMB.1.raw
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (526)..(526): a, c, t, g, unknown or other
  misc_feature (526)..(526): n is a, c, g, or t
  modified_base (533)..(533): a, c, t, g, unknown or other
  misc_feature (533)..(533): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttctcatctttgacagttataaacgctctcaggtactcctgaccgtcttctctggcctccaagtctggcacgtcacgccacccgtggacactccgaccggactccagacgtggggacgaggcctattactacgngacgaanagtgggactacgagcctacgaggtggcgtggggttcgttcgggcggacggaaccaacgtcggacccgtcgtgggcacgcccgaaggcctcgccccgtggtccaccgtcgtccgttccccnccttccncgtacgttacctcgtccgtcgtcgacggccggtcg

SEQ ID NO: 266250 - DNA, 535 bp, Homo sapiens
  misc_feature: GYAE6OF02HM0JU.23.80.H03.1.454.CMB.1.raw
  modified_base (416)..(416): a, c, t, g, unknown or other
  misc_feature (416)..(416): n is a, c, g, or t
  modified_base (527)..(527): a, c, t, g, unknown or other
  misc_feature (527)..(527): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagccccccaacttctcatctttgacagttataaacgactctcaggtactcctgaccgcttctctggctccaagtctggcacgtcagccacctgacatcaccggactccagactggggacgaggccgtattatactggacgaaacagtgggatacaagcctanaggtggcttggggtcgtttcgggcggacgggaccaaagtcgaccgtcgtgggtcagcccaaggctcgccccgtgtcacgtcgtcgttcccacctcctcatacctcgcctcngagcggcg

SEQ ID NO: 266251 - DNA, 569 bp, Homo sapiens
  misc_feature: GYAE6OF02IBURO.23.80.H03.1.454.CMB.1.raw
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggtttccttgtcgctattttagagctgtccagtgtgaggtgcaggtggtggagtcgtgggggaggcctgggtcaggcctggggagtccctggagaatttccngtacatcctntgaattcagtccttatacctggaactgggtccncaggctccgagggaacggcctaggagtgggtctcggtccatcagtcgaagcagtagtttaaagtattaatggtggggtcaggttgaaagggccgacttcaaccattcctccgagtacgaccaacgcccgagaatacactgtactctagacaaatgaaccagcctgaagagcgaggacacgggtgtaatattactgtgtagagaggagacgaggaggaggaagttccggaccgacgacggacccgggaacccgtggtaccaccgtcctcttaccg

SEQ ID NO: 266252 - DNA, 524 bp, Homo sapiens
  misc_feature: GYAE6OF02G9LQY.23.80.H03.1.454.CMB.1.raw
  modified_base (514)..(514): a, c, t, g, unknown or other
  misc_feature (514)..(514): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgctctcaggtactcctgaccgcttctctggctccaagtctggcacgtcagccacctggacatcaccggactccagacgtggggacgaggccgtattactactgcggaacagtgggatacaagcctacgagtcggctgggtgttcgggcggaggaccaaagtcgaccgtcgtgggcagcccgaaggctcgcccgtgcactcgtcgtcccacctcctcatctcgcgtcncgagcggtcg

SEQ ID NO: 266253 - DNA, 558 bp, Homo sapiens
  misc_feature: GYAE6OF02F1SZ9.23.80.H03.1.454.CMB.1.raw
  modified_base (481)..(481): a, c, t, g, unknown or other
  misc_feature (481)..(481): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
  modified_base (547)..(547): a, c, t, g, unknown or other
  misc_feature (547)..(547): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttctcatctttgactagttataacgactctcaggtactcctgaccgtcttctctggctccaagtctgcacgtcactccacctgacactccacccggactccgacgacgtggggacgaggccgatttactacgtggacggaacaggtgggaataacgaagcctacgaggtggcgttggggtcgttcgggacggacggaccaaacgtcgaccgttcgngggtcacgcccgaagcctcgccccgtggtccacgtcgtcgtccccncctcctcattccncgcgtcnggacgcggtcg

SEQ ID NO: 266254 - DNA, 561 bp, Homo sapiens
  misc_feature: GYAE6OF02IG7T5.23.80.H03.1.454.CMB.1.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctggtcaggcctgggggagtccctgagtaatttccngtacatcctctgaattcagtccttatacctggaactgggtccnccaggctccgagggaggcctaggagtgggtctcgtccatcagtcgaagcagtagtttaaagnttagtggtggggtcaggtgaagggccncttcacatctcagacgacaacgccgagaatacactgtatctagacaaatcgaaccagcctagagaagcggaggacgacgggtatatattactgtgtagagaggagacgaggagaaggtacggttcgggaccgacgacgggccccgggaaccttcggtaccaccgtctccgtacg

SEQ ID NO: 266255 - DNA, 585 bp, Homo sapiens
  misc_feature: GYAE6OF02F87KC.23.80.H03.1.454.CMB.1.raw
  modified_base (454)..(454): a, c, t, g, unknown or other
  misc_feature (454)..(454): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctgggtcaggcctggggagtccctgagaatttcctgtacatcctctgaattcagtccttatacctggaactgggtccgcaggctccgagggaaggcctagagtcgggtctcgtcatcagtcgaagcagtagtttaaagtattagtggtggggtcaggtgaacgggctcttcaccatcctaccaagacgacaacgaccgaagaactacacgtagtatcgtagacaaatcgaaccgngcctaggaacgaagccggaacggaccgacggggttataatacgtttacgtgtagtaggaaggaggagacgaggagaggtacgtcggccgacgacggaccccgggtacctcggcctaccggtctccgtaccg

SEQ ID NO: 266256 - DNA, 570 bp, Homo sapiens
  misc_feature: GYAE6OF02I2M8H.23.80.H03.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
  modified_base (401)..(401): a, c, t, g, unknown or other
  misc_feature (401)..(401): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggaccaggcggtcaccatttcctgctcgggaancacctccaacattgggactcatggtntttcctggtaccagcagatcgcagaacacgcccccaacttctcatctttgactagttataaacgactctcaggtactcctgaccgtcttctctcggctccaagtctgcacgtcagccacctgacatccacggctccagacgtgggacgacggccgtattactactggacgaacngtaggatacacgtcctgagtgacgtgggtcgttcgggacgggacggacctaacgtcgacccggttcgtagggtccgacgccgaagccgtcgtcccctacggtcctaccgttaccgtcggttccccgccctccgtaccacttaccgacgtccgtactcggtggcgtccgg

SEQ ID NO: 266257 - DNA, 766 bp, Homo sapiens
  misc_feature: GYAE6OF02H0MSL.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagccccccaattctcatcttgacagttataaacgctctcaggtacctcctgaccgcttctctggctccaagtctggcacgtcacgccaccctggacatccacccggactccgagacgtgggggaccgacggccgtagtttaacgtttacgtcggaccgggtaaactagttaggggaacttaaccgaaacggtcccttaccgaaggttcgggaccgtttgggggttaccggtttacggggccggggaaacgggggtaaccctaaaaccggttcgggaaaccccgggttcccgttacggggggttacccaaccgggtacccccgtaaaaggggtcccttacccggggaccccccccgttaccggggttacccgtaaccccgtttcccggttaccccggtttttcccccccggcccccgttttcccccgttaccccgtaacggtttaacccccgttcccgggtaccccgggttttacccgtttaccggggtaccggggtcccgggggttacccgg

SEQ ID NO: 266258 - DNA, 769 bp, Homo sapiens
  misc_feature: GYAE6OF02HX6ZC.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcacttttctgcggccccaggacaggcggtcaccatttcctgctcgggaagcacctccaacattgggactcatggtgtttctggtaccagcagatcgacgaggaacacgccccccaacttcctcattctttgactagttaactaacgactctcaggtactcctgaccgtcttctctcggctaccgaagttccgtggccacggtcacgccccaacccgttcggaactacgtccgaacccggtacctacccgaacggaccggtacggggggaaccggaacgggtacccggtaacttttaacggttaccgtacgggaccgggtaaaacgtaggtacgggggtaaattaaaccgaaacgtcccgttaacgaagggttcgggttaccggtttgggggttacggttccggggaacgggggtaacggggaaaccccttaaacggtccggtaacccgggtccggtttacgggggaccctaaccgggccccgtaaacggggtccgtaccccgggacccccgttcggttacccgtaccgttacccgtccggtttaccccccacccggtttaccttaccgaaccggttacctccgggtacccgttccggtaggtaccgggccggggtacg

SEQ ID NO: 266259 - DNA, 631 bp, Homo sapiens
  misc_feature: GYAE6OF02FQ3BI.23.80.H03.1.454.CMB.1.raw
  modified_base (295)..(295): a, c, t, g, unknown or other
  misc_feature (295)..(295): n is a, c, g, or t
  modified_base (314)..(314): a, c, t, g, unknown or other
  misc_feature (314)..(314): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcacttttctgcggccccaggacaggcggtcaccatttcctgctcgggaagcacctccaacattgggactcatggtgtttcctggtaccagcagatcgcaggaacacgcccccaattctcatcttgactagttataacgactctnaggtactctgaccgcttcnctggctccaagtctggcacgtcagccaccgtggacatcaccggctccagacgtgggacgacggccgtaattacgtacgtggacggaacgtagtagggaactacgaacgtcctacgaggtcgggcgttgggttacggttccgggacgggacgggtaaccctaaacgtcggtacccggttccggtggggtaccacgggacccgaaggtcccgtaccgggcccccgttagggtcctaccgttcgttacccgttccccctaccccgttcctaccgtaacttccgtaccggtccggttccgtacggtaccggcgggtaccgg

SEQ ID NO: 266260 - DNA, 568 bp, Homo sapiens
  misc_feature: GYAE6OF02INFSJ.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaacttctcatctttgacagttataaacgactctcaggtactcctgaccgcttctctggctccaagtctgcacgtcagccacctgacatcaccggctcagacgtggggacgaggccgtattattacgtgacggaacagtgggaatacgaacgtcctacgagtcggcgttgggtcgttcgggcggaacgggaccaaacgtcggacccgtcgtcgggtacacgcccgaagggcctccgccccgtggtccctactccgtcgttcccccacccttcctcctactccgtcgccgtcgtcgacggtcggtccg

SEQ ID NO: 266261 - DNA, 561 bp, Homo sapiens
  misc_feature: GYAE6OF02FI9XB.23.80.H03.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttccnggtaccagcagatcgcaggaacacgccccccaacttctcatctttgacagttanaaacgctctcaggtactcctgaccgtcttctctggctccaagtctggcacgtcacgccaccctggaccactccgacccggactccgagacgtgggggaccgacgggccgtattacttacgtgccggtaacagtgggaataccgaagcctacgaggtcggctggggtcgttcggcggagggacccaaagtcgaccgtcctggggtcacggcccaaggctcgcccctggccactcgtccgtcccnccctccncattcnccgcgttcncgngcggtcg

SEQ ID NO: 266262 - DNA, 576 bp, Homo sapiens
  misc_feature: GYAE6OF02HGATQ.23.80.H03.1.454.CMB.1.raw
  modified_base (493)..(493): a, c, t, g, unknown or other
  misc_feature (493)..(493): n is a, c, g, or t
  modified_base (519)..(519): a, c, t, g, unknown or other
  misc_feature (519)..(519): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctggtcaggccgtgggggagtccctgagtaatttcctgtacatcctctgaattcagttccttatacctggaactgggtcccgccaggctccgagggaacggcctaggagtggtctcgtcatcagtcgaagcagttagttaaagtattagtggtggggtcaggtggaagggccgtcttacacctatcctaccgaggacgaccgaaccgaccgaagaaactacacgttgtaactcgtagacaaatcgaccagcctagagagcggaggacgagggtntatacgttacgtgtagtgagaggganacgaggagaggagttcggccgcgacggcccggaccgtcggtaccacccgtctactcg

SEQ ID NO: 266263 - DNA, 695 bp, Homo sapiens
  misc_feature: GYAE6OF02F5JRI.23.80.H03.1.454.CMB.1.raw
  modified_base (298)..(298): a, c, t, g, unknown or other
  misc_feature (298)..(298): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtgggggaggcctgggtcagggcctgggggagtccctgagaatttcctgtacatcctctgaattcagtccttatacctggaactgggtccncaggctcgagggaaggcctagagtggtctcgtccatcagtcgaagcagtaagttaaagtattagtggtggggtacaggtaggaacgggccgtcttacacctatcctacccgaggaacgaccaaccggaccgaagtaaactaacaccgttgtactcgtagacaaagttcgaaccgacggaccctaggaaacggtaacggaccggaacgggtaaccgaaccggggggttattaaagtttaacgtttaaccgttaggttaggtaagggtaagaacggggtagaaccggaagggtaacggtaacgggttaccgggttaccgggaccccgacggtaacccgggtacccccgggggtaacccttgggggtacccccaacccggtttccgtaccgttaacccgg

SEQ ID NO: 266264 - DNA, 608 bp, Homo sapiens
  misc_feature: GYAE6OF02I8TNZ.23.80.H03.1.454.CMB.1.raw
  modified_base (276)..(276): a, c, t, g, unknown or other
  misc_feature (276)..(276): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
tcagacgcgagtatcacgaccggtgctcgatttagctgtgcgtcgaagggaaaggggacgaatcttcatcatgacctgctccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggacagccccaactctcatctttgacngttataaacgatctcaggtactcctgaccgnttcctctggcctccaagtctggcacgtnacgccacctggacnctcacggactccagacgtgggggacacggcccgaatttacttacgtgacggaactagtcgggattaacgaaggtccctacgacggtggcgttaggggtgtttccgggcgggtacgggaccgtaaacgtcggacccgttacgtggggttaccaggtcccgaaaggccttaaccggccccgttccggtctaaccgttcctcggtttcccacccgttccctacaccttacgtccggaccgttccgtaggtacggtcggtccg

SEQ ID NO: 266265 - DNA, 674 bp, Homo sapiens
  misc_feature: GYAE6OF02IAWE6.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcacttttctgcggccccaggacaggcggtcaccatttcctgctcgggaagcacctccaacattgggactcatggtgtttcctggtaccagcagatcgcaggaacagccccccaattctcattctttgacagttataaacgactctcacggttactcctgaccgcttctctggctccaagtctggcacgtcacgcccaccctggacatccgaaccggactacccagaccgtgggggaccgaggaccgtaatttagtttaccgtggaccggtaaacagtagggaacttaacgaaacgtccgttacgaaggttcgggacgtttggggttcggttccggggacgggaacggggtaacccaaacgttcggaacccggttccgtacgggggttaccaccggtaccccgaaagggtccgtcccggccccccgttggtacccacccgtttccgtccggttaccccccacccgttccctacctaacgttcccgtccggtccgtttccgtcggtacccgggtcgggtacccgg

SEQ ID NO: 266266 - DNA, 542 bp, Homo sapiens
  misc_feature: GYAE6OF02JUYHE.23.80.H03.1.454.CMB.1.raw
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
  modified_base (476)..(476): a, c, t, g, unknown or other
  misc_feature (476)..(476): n is a, c, g, or t
  modified_base (508)..(508): a, c, t, g, unknown or other
  misc_feature (508)..(508): n is a, c, g, or t
  modified_base (523)..(523): a, c, t, g, unknown or other
  misc_feature (523)..(523): n is a, c, g, or t
  modified_base (531)..(531): a, c, t, g, unknown or other
  misc_feature (531)..(531): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtctgggggaggcctgggtcaggcctgggggagtccctggagaatttcctgtacatcctctgaattcagtccttatacctggaactgggtccgcaggctccgagggaaggcctagagtgggtctcgtccatcagtcgaagcagtagttaaatattagtggtggggtcaggtgaagggtccgcttcaccatctccagagacacgcganaatacactgtatctagaccaagtcgaccagcctagagagcgaggacgacgggtntatagtcgtgngtagaggagagagaggagaggtagtccggcgngacggcccggtaacncggtaccnccgtctctccg

SEQ ID NO: 266267 - DNA, 653 bp, Homo sapiens
  misc_feature: GYAE6OF02I9W77.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacagcccccaattctcatctttgacagttataaacgactctcaaggtactccgtgaccgtcttctcgtggctccgaagtctggcacgtcagcccaccgtggacatcacggctccagctggggacaggctattatacgtgacggaacagtgggaactacgaagtcccgtacgaaggttcggtacgttcggggttggtttaccggggacgggtaacggggaacccgtaaaacgttcggaacccggttccgtacggggttaccaccggtacccgaaacggtccgtacccgcccccgttacggtccgtaaccgttccgtaccggttccccctaccccgttcccgtacccgtaaccgttacccggttccggtccgttacccggtacggtaccggtcgggtacccgg

SEQ ID NO: 266268 - DNA, 607 bp, Homo sapiens
  misc_feature: GYAE6OF02IQLQE.23.80.H03.1.454.CMB.1.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (411)..(411): a, c, t, g, unknown or other
  misc_feature (411)..(411): n is a, c, g, or t
  modified_base (478)..(478): a, c, t, g, unknown or other
  misc_feature (478)..(478): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtgggggaggcctggtcaggcctggggacgtccctgagaatttcctgtacatcctctgaattcagtccttatacctggactgggtccncaggctccgagggacggcctagnggtggtctcgtcatcagtcgaagcagtagtttaaagtnttagtggtgggtcaggtgaagggcctcttcaccatctccagacgacaacgcgaanaactacactagtatcgtgacaaatcgaaccacgcctagaacgaagcggaacggacgtaacggggttntaagttacgttacgtgtaggtagaggaagggacgacgtaagggagaacggtacggttaccgggcccacggacccgggtaccccgggtaacccgttcgggtaccctaacccggttcctaccgttacccgg

SEQ ID NO: 266269 - DNA, 638 bp, Homo sapiens
  misc_feature: GYAE6OF02IH940.23.80.H03.1.454.CMB.1.raw
  modified_base (358)..(358): a, c, t, g, unknown or other
  misc_feature (358)..(358): n is a, c, g, or t
  modified_base (416)..(416): a, c, t, g, unknown or other
  misc_feature (416)..(416): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggccccaggacaggcggtcaccatttcctgctcgggaagcacctcaacagttgggactcatggttgtttcctggtaccagcagatcgcaggaacacgcccccaattcctcatcttagactagttaataacgactctacaggtacctcctacgaccgtcttctctcgctccaagtctggctacgtcacgcccaccgngacctagtaccgacggacctacgagtacgtacggggacgacggacgtattagttacgnggacgtaacgagtagggtactaacgacgcgtacgtaggtcggtcgttggggttcggttaccgggacggggtaacggaaaccctaacggtacggtaaccggtccggtacggtaccgacggtacccgaacggtccgtacccgccccgtgtaccaccgttccgtcccgttacccacccgttccctacgtaccgttcgtccgttcgtccgtaggtccgcggtaccg

SEQ ID NO: 266270 - DNA, 545 bp, Homo sapiens
  misc_feature: GYAE6OF02GTMNK.23.80.H03.1.454.CMB.1.raw
  modified_base (299)..(299): a, c, t, g, unknown or other
  misc_feature (299)..(299): n is a, c, g, or t
  modified_base (409)..(409): a, c, t, g, unknown or other
  misc_feature (409)..(409): n is a, c, g, or t
  modified_base (477)..(477): a, c, t, g, unknown or other
  misc_feature (477)..(477): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtgggggaggcctggtcaggccgtgggggagtccctgagtaatttcctgtacatcctctgaattcagtccttatacctggaactgggtcccncaggctccagggaggcctagaggtgggtctcgtccatcagtcgaagcagtagtttaaagtatttatggtggggtcaggtaggaagggccgtcttcaccatcctccagaanacaacgaccgaagaactaacactgtatcgtagacaaatcgaacagcctgagaagcgaggacgagggtntatattactgtgagagagagacgagagagagttcggcgcgaggcccggaccgtcggcacgtctctacg

SEQ ID NO: 266271 - DNA, 651 bp, Homo sapiens
  misc_feature: GYAE6OF02HCZ99.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgccccccaattctcattcttgacagttataaacgactctcaggtactcctgaccgcttctctggctcagtctggcacgtcagccaccgtgacatccgaccggtactaccgagtaccgtcgggggacgacggaccgtaatttacgttacgtcggacggaactagtgggtactaacgacgcctacgaggtggtccgttgggttcggttaccgggcgggtaagggaccctaaacggtcggtacccggtccgtaggggtaccaccgacccgtacggtcctccggcccccgttcggtacctaccgtttccgttcccggttacccccaccccgtttccctacccgttaacgttacccggttcccggtccgttaccgtacgggtacgggcccgggtaccggg

SEQ ID NO: 266272 - DNA, 735 bp, Homo sapiens
  misc_feature: GYAE6OF02JO42B.23.80.H03.1.454.CMB.1.raw
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
  modified_base (713)..(713): a, c, t, g, unknown or other
  misc_feature (713)..(713): n is a, c, g, or t
tcagacgcgagtatcacgaccggtgctcgatttagctgtgcgtcgaagggaaaggggacgaatcttcatcatgacctgctccctctcctcctcacccttctcattcactgcacagggtcggtgggcccagtctccatttgacgcagccgccctcactttctgcggcccaggacaggcggtcacctatttcctgctcgggaagcacctccaacattcgggactcagttggttcgtttccgtggtaccagcaaggctcgacacggaacncgacccccgtaattcctacattcttgactagttaactaaacgactntaccgaggtacttctcgaccgtcttctcgtggtacctacgtacgttctccggtctaccgttcgacgccctaccgttaggactacctcgaacccgttaccgccgtaaggaccgttagggggaccgtaacgggccgttaactttacggttaacgtacggtaccggtaaagtccggtagggtaaactacgtaaacgtcccgtaacgtacggttacgggtcgttggggttccggttacgggaacggggttaccggaaacctaaacggtcggtaacccgttccggtacggggacccgtaacggacccgtaaggggtccttacccgggtcccccgtacgttaccgtaccgtccgttttaacccgtaccccgttaccctcccgttaacaccgtttacggccgttacnccggtagaccgggtcgtaccgg

SEQ ID NO: 266273 - DNA, 714 bp, Homo sapiens
  misc_feature: GYAE6OF02I1AQZ.23.80.H03.1.454.CMB.1.raw
  modified_base (198)..(198): a, c, t, g, unknown or other
  misc_feature (198)..(198): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccattcctgctcgggancacctccaacattgggactcatggtgttcctggtaccagcagatcgacaggaacacgcccccaattcctcattctttcgaactagttaactaaaacgcttacgtcaggtacttcctgacccgctttcctcgtacggccttacctaagtccgttcggccaccggttccacggacccctaccccgtggaacctagtacccaaccgggaacccttacaacgtaccggttacgggggacccgaacgggccgttacgttaacgtttaccgtacggtaccgggaaactaggtacgggtaacttaacaacgggcccttcgaaggttcggacgtttggggttcggttaccgggccgggtaaacgggaccgtaaacgtcggtacccggtccgttacgggtccgacgaccccggtaaggccgtccgaccccgttaggtccaaccgttccgttcccgttaccccaccccgttcgtaccctaacgttacccgaccggttaccgtcccgtacgtacgggccgggtacgg

SEQ ID NO: 266274 - DNA, 589 bp, Homo sapiens
  misc_feature: GYAE6OF02FWW8L.23.80.H03.1.454.CMB.1.raw
  modified_base (452)..(452): a, c, t, g, unknown or other
  misc_feature (452)..(452): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctcaacagttgggactcatggtgtttcctggtaccagcagatcgacaggaaccacgccccccaattcctactatccttttagactagttaataaacgctctcaggtacctcctgaccgtcttctctcggctaccaagtcgtggacacgtcacgcccaccgtgacacgtccgaccggactccaggacgtacggggaccgaggcctattactacgtcgacggaacagtaggaatacacgcctagagtcggngtgggtgtcgggacggtaggaccaagtcgaccgttcgtagggtccacgaccgacgctccgcccctggtacctacgtccgtcgttccccacctcctacgacttaccgtccggtccgttcgacggtcggtccggtacgg

SEQ ID NO: 266275 - DNA, 834 bp, Homo sapiens
  misc_feature: GYAE6OF02J190Z.23.80.H03.1.454.CMB.1.raw
  modified_base (204)..(204): a, c, t, g, unknown or other
  misc_feature (204)..(204): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggccccaggacaggcggtcacctatttccctgctcggggaanccaccctaccaaactagtttcggggaacctcgaattggggttcgttttcccgtcgggtaacccagccgtagtaacttcggacgaacggaaaccgaccgtaccccccctaaatttcctactactttaccgttttaggaactaggtttaaactaaaccggtaccttccgtaccgtaacgggttacccttacccggtacggtaacccgttccgttttccgtaccggttaaccggcccgtttacctaaacgggttccgtacggtaaccgtaccgttaccgaccggtacccctaacccgtacgggactacgtacccggaccgtaccttaccgaacggtaccgggtcggggaaccggtacggtacccgttaatttaccgttacgtcggtaaccgggaattaacgggtcggaaattaccggaacgtccgttacggaggttcgggacggtttacggggtacgtccggggaccggtaacgggtaaccctaaacggtcggttacccgtacggtcgggtaccgaccgggtaccacgggttcccgcccggtacccgttccggtacttacgtcccgtacccgttacccgccttccgtaccgttacgtccgttaccggtcttacggtacgttacggacggtccg

SEQ ID NO: 266276 - DNA, 622 bp, Homo sapiens
  misc_feature: GYAE6OF02FNXNT.23.80.H03.1.454.CMB.1.raw
  modified_base (303)..(303): a, c, t, g, unknown or other
  misc_feature (303)..(303): n is a, c, g, or t
  modified_base (372)..(372): a, c, t, g, unknown or other
  misc_feature (372)..(372): n is a, c, g, or t
  modified_base (504)..(504): a, c, t, g, unknown or other
  misc_feature (504)..(504): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggagcctggtcagggcctgggggactccctggagtaatttcctgtacatcctctgaattcagttccttaatacctggaactcgggtcccncaggcctccgaggggaacggcctaggagtgggtcctcgtccatcgagtcgaagcagttaagtttaaagnttagtggtggggtcaggtaggaacgggcctcttacaccgtatcctacagacgacaacgccgaagaactacgacttagtatcgtagactaaatcgacacgtccgtagaagaacgcggaaggacgtacggggtntaattacgttagtgtaggtgaaggagggagtacgaggacggaggtacggttccgggaccgaccggaccgggaccccgggtaaccgttccgggtaccctacccggttctaccgttaccg

SEQ ID NO: 266277 - DNA, 903 bp, Homo sapiens
  misc_feature: GYAE6OF02IOM5Z.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctatttagaagctgtccagtgtggaggtgcagggtggtggacgtcgtggggggagccgtgggtcacgggccgttgggggacgttccccgtggtaacggtaattttccccgtaggtacctaacgttcccgttcctaggtaaactttccgtaacggttaccccttttaagttaaccccggtacgggttaaaaccgttcggggggttaccccaccccggttaaggggcctttaacccccgggaaaggggggttaaacggggttaccgttaaacggttaagggttccgggggttccccttccggttaccccgtaaagtttcccggaaacgggttacccgggaaaaggttccgttaaaggtttaaacggttttaaaaaccgttttaagttaacgttggggttacggggtacctaaggttacgggtaaccgggcccggtctttaccgaaccgttagtccgtaccctaggaacggttaaccaaccggtacgaaacgtaaataacccgtacgttaggttaactcgtaacgaaccgtaaaacgtcgtaaaccctaaggtcccgttaagaaggtaaccggacggtaaacggacccggtaagggtatttaaacgtactttacgtaggtcggtaaggaacggtaggtaaccgacgtaaacgggtagtacggacggtttaccgggaccgaacgacccggggttaaccccggtaacccgtcggtacccgttacccggttcgttaaccgttccg

SEQ ID NO: 266278 - DNA, 655 bp, Homo sapiens
  misc_feature: GYAE6OF02JRUE2.23.80.H03.1.454.CMB.1.raw
  modified_base (476)..(476): a, c, t, g, unknown or other
  misc_feature (476)..(476): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccattcctgctcgggagccacctccaacattgggactcatggtgtttcctggtaccagcagatcgcaggaacacgccccctaattcacatctttgactagttataaacgactctacacggtactcctacgaccgtcttctactcggctaccgagtcctggactacgtcacgtcccaccgtggacctactccgtacccggactcccgaggtaccgttcggggaaccgacggtaccgtatttacgtacgttacggaccggaacctaggtacgggaattaacgaacgtcccgtaacgnggtcggacgttcgggttcgtacgggacgggtaacggacctaaaccgtggtaacccgttccgtaggggtaccaccggtaccgaaccgggtcctaccggtcccccgttacggtcctacgtccgtaccgttccccgacctccgtacgtacctcgaccgtcgtacctcgggtacgccggtacg

SEQ ID NO: 266279 - DNA, 694 bp, Homo sapiens
  misc_feature: GYAE6OF02JM4P3.23.80.H03.1.454.CMB.1.raw
  modified_base (286)..(286): a, c, t, g, unknown or other
  misc_feature (286)..(286): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (419)..(419): a, c, t, g, unknown or other
  misc_feature (419)..(419): n is a, c, g, or t
  modified_base (472)..(472): a, c, t, g, unknown or other
  misc_feature (472)..(472): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggtttcctgtcgctatttagaagctgtccagtgtgaggtgcgaggtggtggagtcgtgggggaggcctgggtcagggcctggggacgtcccgtgagtaattcctgtacatcctctgaattcagtccttactaccgnggaacgtgggtcccgcaggctccgaggggaggtcctagagtggtctcgtcntcagtcggaanctagtaagtttaaagtattagtggtggggtactaggtaggaacggccggtctacgacctatcctacagganacgaccgacgaagaactacgacttgtagtctagaactaaacgtcgtaacccgngttaccgtaggaagtaggaaccgggtaagggtaaccggtaccgggtaagttaactttaacgttaccggttacgtcggttaggaacgggtaacggggtaacggaaccggaagggagggtaaacggttacgggttaccgggacccggtaccggaacccgggtaccccccggggtaaacccgttcgggttaacccggacccgtttaccggtccccgttaaccggg

SEQ ID NO: 266280 - DNA, 874 bp, Homo sapiens
  misc_feature: GYAE6OF02HFVSJ.23.80.H03.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggccccaggacaggcgtcaccatttccngctcgggaancacctccaacattgggactcatggttgtttcctggtaccagcagatcgacaggaaccacgacccccctaattcctactacttctttagaccgtaagttaactaaaccgtactctacgtaacggtaccttccgtcggtacccgtcctttcctacgttccggtccttaccgtaaacggttccgtacgggtccgtaaccggttccaaccgtccccgtaaccccgttacgggaacctaccgttacccgaaccccgggtacctacccgtaacggtaaccgggttacgggggaaccggaccgggtaccgttaacgtttaacgttaccgtacgggaacggtaaacgtaggttacggggaacttaaccgaacggtcccgttacgacgggttcgggaccgggtttgggggttacgggttacccggggacggggaaaccgggtaaaccctaaaaccgggttccggtaaccccgggttacccgggttacgggggtaacccgtacccgggtaacccggtaaaccggggtcccttcccccgggtaccccccgtcggggttacccctaaccggtttccccggttcccggtttaacccccccttaccccgttacccgttacccgtaaccgtttaccccggtcccggttaccgttacccgggtaccgggaccggggtcccgggttacggg

SEQ ID NO: 266281 - DNA, 551 bp, Homo sapiens
  misc_feature: GYAE6OF02FI7X8.23.80.H03.1.454.CMB.1.raw
  modified_base (319)..(319): a, c, t, g, unknown or other
  misc_feature (319)..(319): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtctgggggaggcctggtcaggcctgggggagtccctgagaatttcctgtacatcctctgaattcagtccttatacctggaactgggtccgccaggctccagggaagggcctagngtgggtctcgtcatcagtcgaagcagtagttaaagtattatggtggggtcagtgaaggcgctcacatctccagacgacaacgccgagaacacactgtatctgacaatcgacagtctaggagagcgaaggacgacgggtgtatattactggtgtggagaggagacgaggagaggtacgttcgggccgtacgacggaccccgggaccgtgggtaccacccggtctccgttaccg

SEQ ID NO: 266282 - DNA, 155 bp, Homo sapiens
  misc_feature: GYAE6OF02JH3ZW.23.80.H03.1.454.CMB.1.raw
  modified_base (100)..(100): a, c, t, g, unknown or other
  misc_feature (100)..(100): n is a, c, g, or t
  modified_base (136)..(155): a, c, t, g, unknown or other
  misc_feature (136)..(155): n is a, c, g, or t
tcagacgcgagtatcacgaccggtgctcgatttagctgtgcgtcgaagggaaaggggacaatcttcatcatgacctgctcccctctcctcctcacccttntcattcactgcacagggtcgtgggcccagtctcctnnnnnnnnnnnnnnnnnnnn

SEQ ID NO: 266283 - DNA, 669 bp, Homo sapiens
  misc_feature: GYAE6OF02FYZQJ.23.80.H03.1.454.CMB.1.raw
  modified_base (626)..(626): a, c, t, g, unknown or other
  misc_feature (626)..(626): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcggtcaccatttcctgctcgggaagcacctcaacattgggactcatggtagtttcctggtaccagtcagatcgacaggaaccacgcccccaacttctcaattctttagactagttaataaacgactctacacggtactcctgaccgtcttctcgtggctccaagtctcggcacgtcacgcccaccgtggacctatccgacccggacctaccaacggaccgtacgggggaaccgacgggtacccgtaatttaacgttaccgttacgggaacccggtaaacgacgttacggggaaataccgaaacggtcctacggaagttcgggcgttagggggtggtttaccggggacgggtaacgggaaccctaaacgttccgggacccggttcgtacggggtccaacggacccgaaggcccgtaccgtccccgtggtaccaccgttcctaccggtccccncctacctccacttacgtccgccgttccgcgtacggcggtaccg

SEQ ID NO: 266284 - DNA, 1007 bp, Homo sapiens
  misc_feature: GYAE6OF02HS1ZM.23.80.H03.1.454.CMB.1.raw
  modified_base (276)..(276): a, c, t, g, unknown or other
  misc_feature (276)..(276): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagagctgtccagtgtgaggtgcaggtggtggagtcgtgggggaggccgtgggtcgaggccgtgggggacgttcccctaggagtaacttttcctagtacactcctntagtaatttccaggttcccttaagtacccgttaggaaccgttcggggtacccgcccgtaagggccttacccggaagggggaacggggtacccgttaaggacgggttcgggggtccttaccggttccccgagttccgaacggttccgaaaggtcctaaaggtttaaacggtttttaaaagttactttaagtttcggggttaggggggttactaagggttacgggaaacggggtccccgtaccgtttacccgaacccgtaaacgttcccgttaccccgaagggtaaaccggaaacccgtaaaaccgggacccccggtaaaaaggtaaaacccgttaaaacccgtaaccgtttaacgggtttaaaccttacccggttaaacggtaaaccctaaaaacggttacccgggtaaaaccccgtaacgggttaaccccgttaagggaaaaaccgggaaacgggtacccggggaaaacggggtaaaccgggtaacccgggggttttagtttaaaaccgtttaaccggtttttaaaccggttagggttttaacgggttacgggtaaaacggggaacgggggtaaacgggaaccgggtaagggggaacgggtaaacgggggttaaccgggtttccccgggggaaccccggttaccggaacccgggggtacccccgggggttaaaccccggttccgggttaccccgtaaccccgggtttcccgtttacccggttaaccccggg

SEQ ID NO: 266285 - DNA, 843 bp, Homo sapiens
  misc_feature: GYAE6OF02IAV1X.23.80.H03.1.454.CMB.1.raw
tcagacgcgagtatcacgaccggtgctcgatttagctgtgcgtcgaagggaaaggggacaatcttcatcatgacctgctcccctctcctccctcacccttctcattcactgcacagggtcgtgggcccagtctccattgacgcagccgccctcactttctgcggccccaggacaggcggtcaccatttcctgctcgggaagccacctccaacagttcgggactcagttggttcgttttcctggtaccagcagactcgacaggaaaccacgacccccctaacttctactattctttagaactagttaactaaacgtactactatacggttacctccgttacggacctcttctccgtcggtcctaccgtaacgtcgtcggacctaccgtacacgtacccacccgtacggaactacgtaccgaacccggtacctacccgacggtaacgtacgggggaaccgtacgggtaccgttaacgtttacgttaacgtacgggaaccggtaaacgtagggtacgggtaaacttaacgaaccgtacccgtacggaacggttcgggtccgggtttagggggtttacgggtaccgggggtaacggggtaacccggggtaaacccgtaaaccgggttaccgggtaacccgggttacccggtacggggtaaccgtaaccggaacccgtaacggggtccctaccccgggtacccccgtaccgggttaccttaacccggtttcccggttacccggtttccccccgtaacccgttcccccgtttaaccgtaacccgtttaccccggttcccgggttacccggtttaccgggtaccgggtacccggtcgggggttaacccgg

SEQ ID NO: 266286 - DNA, 585 bp, Homo sapiens
  misc_feature: GYAE6OF02FU4AS.23.80.H03.1.454.CMB.1.raw
  modified_base (326)..(326): a, c, t, g, unknown or other
  misc_feature (326)..(326): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtggggggaggcctgggtcagggcctgggggacgtcccctgagaatttcctgtacatcctctgaattcagtccttatacctggaactgggtcccgcaggctccgaggggaaggcctagnggtgggtctcgtccatcagtcgaagctaagttaagtttaaagtattagtggttgggggtcaggttggaacgggccgctttacgacctatctccgagacgacaacgcgaanaanacatgtatctagacaaatcgaccagcctagaagaacgcggaaggacgacgggtagtaattattacgtgtgtagagaggagacgaaggaggaagtaggttccggacgcgacggccccgggaaccgtcggaccgaccgttctcgtccg

SEQ ID NO: 266287 - DNA, 612 bp, Homo sapiens
  misc_feature: GYAE6OF02IHU8X.23.80.H03.1.454.CMB.1.raw
  modified_base (349)..(349): a, c, t, g, unknown or other
  misc_feature (349)..(349): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggcccccaggacaggcggtcaccatttcctgctcgggaagcacctccaacattgggactcatggtgtttcctggtaccagcagatcgcaggaacacgacccccaacttctcacgttcttagacagttataaacgactctcaggtactcctagccgcttctctgctcaagtctggcacgtcagccaccncggacatcgaccgactccgagacgtgggacgacgcgtattatacgtcgacgaacagtaggactacgacgtcctagagtggcgttgggtcggttaccgggacgggtacgggaacctaaacgtacggacccgttcgtacgggtcgacgacccgaacgcgtcccgtccccgtacggttccaccgtttccggtccgttaccccccgcctttaccccgacttaccgttaccgttccggccttaccgtcggtaccgggccggtaaccgg

SEQ ID NO: 266288 - DNA, 739 bp, Homo sapiens
  misc_feature: GYAE6OF02HTH58.23.80.H03.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (247)..(247): a, c, t, g, unknown or other
  misc_feature (247)..(247): n is a, c, g, or t
tcagacgcgagtatcacgaccggtgctcgatttagctgtgcgtcgaaggggaaaggggacaatcttcatcatgacctgctcccctctcctcctcaccccttctcattcactgcacagggtcgtgggcccagtctccattgacgcagcccgccctctactttctgccggccccaggacaggccggtcacctatttcccngcgtcgggaancaccctccaacagttcggactcattggttcgtttccgnggtaccagcagactcgcaggaccaccgaccccctaatcctacattcttcgactagtaactaacgactctactagtacctccgtacgaccgtcttctcttcggcctacctaagtctcggactaccgtcgacgtcccaccgtacgactacgtccgaacccggtacaccgacgtaacggcggggaacgacgggtacctagtttacgtacgtcggacggaacgtaggtaacgggtaactaacgaaccgtcccgtaggtaggttaccgggtcggttacggggtacggttccgggaacggggtaaccggtaacccgtaacgggttccggacccgggtttccgggtacgggtaaccgtaccggaacccggtaacgggcccttacccggccccgtaaggttcccgtaccgttcccgtttcccggttcccccgtacccttaccgttacccgtacccgttaccgttccggaccgtttccgtacggacccgggttcggaccgg

SEQ ID NO: 266289 - DNA, 805 bp, Homo sapiens
  misc_feature: GYAE6OF02GVLFY.23.80.H03.1.454.CMB.1.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtcgggcccagtctccattgacgcagccgccctcactttctgccggccccaggacaggcggtcacctatttccngcgtcgggaagccacctccaacagttgggactcagtggttcgtttccgtggtaccagcagatcgacaggaacaccgaccccctaacttcnctatcgttgaactagttaactaacgctctcgtaggtcctcgtcgacctcttctctggtcctacctaagtctcggactacggtacacgacctaccctaggtaacactaccgaccggaaccttccaacgggtacggtggggaaccggtacgggaccgttaacgtttactaccgtacggaaccgggaacgtaacggtacggggtaaacttaaaccgaacggtacccgtacggtacgggtacggggttacgtttggggggttaccggttcgggggaaccggggtaacgggtaaaccccggttaaagggttaccgggtaaccccggtttccgggtacgggggtaaacccgttaccggaaccccgggaacgggtttacccgtacccccggtacccccggttccggggttaaccctcccggttttacccgttacccggtttacccccctacccggttacccgttacccgaacgttttccccggttaccggtcccggttacctacggggttacggcccggggtaacccgg

SEQ ID NO: 266290 - DNA, 782 bp, Homo sapiens
  misc_feature: GYAE6OF02IUWIT.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctccgctggtttccttgtcgctatttagaagctgtccagtgtgaggtgcaggtggtggagtcgtgggggaggcctggtcaggccgtggggagtcccctgagtaatttccgtgtacagtcctctagtaattcagttccttataccgtggaacgtcgggtcccgccgacggcctacccggaggggaacgggtcctaaggtaggtacgggtcctccgtccaagtcgaggtacgaacggtctaggttaagtttaaacgttagttaacgtgggttagggtaccaggttaggaaacggggtcccgtacgttacccgtacctacttccgtaccgaaacggtacgaaccgtaaccgggaccgaaacgtaaacttaccgaacgttaggttaactacgtacgaacgtaaagtcgaacccgagtaccgtagaacggaaaggtaccgggaagggtaaccgtacggggttgtaaattacgttaacggttcgggttaggtaagggacggtaagggtaaccggtaggaacggggtaacgggtaaacggttcgggttaaccccgggccgggttaaccggaccccgggggtaccccccgggttaaacccgtacggggttaccccgtaaccccggtttccgttacccggttaaccccgg

SEQ ID NO: 266291 - DNA, 738 bp, Homo sapiens
  misc_feature: GYAE6OF02JHA2M.23.80.H03.1.454.CMB.1.raw
  modified_base (306)..(306): a, c, t, g, unknown or other
  misc_feature (306)..(306): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcgaggtggtggagtcgtgggggagccgtggtcaggccgtggggacgtccctggagtaatttcctagtacatcctctgaattcagttccttataccgtggaacctggggtcccnccgagggcctaccgaggggaacgggtccctaaggtacggtcgggttcctccggtaccctagttccgaaggtcccgaaagccgtaaggtttaagtttaaaagtatttagtgggttggggtacaggttaggaacgggccgtacttaccgacctatcctccgaaggacaaccgaaccgccgaagtaaactaccgacttaggtactcgtagtaacaaagtcgaaccacgtaccctaaggaagtaacggcggaacgggaaccgtacggggttattaaagttaacgttttaaccggtggttaggtaaacgggagggtaacgggaacggaccgtaaggggagtaaacggggttcggtttaccgggggacccgtccggaaccgggtcccccgggaaacccggtttcggaaccccgtcccggttccgttacccttacccgg

SEQ ID NO: 266292 - DNA, 832 bp, Homo sapiens
  misc_feature: GYAE6OF02IWLSS.23.80.H03.1.454.CMB.1.raw
tcagacgcgagtatcacgaccggtgctcgatttagctgtgcgtcgaaagggaaaggggacaatcttcatcatgacctgctccctctcctcctcacccttctcattcactgcacagggtcgtgggcccagtctccatgacgcagccgccctcactttctcgccggcccccaaggacagggccggtccaacctattttcctgcctacgggaagccaccctacccaactagtttcgggacctcaagttgggttcgtttccgtcggtaccctagcacgacgtcgacgaggaaccaccgaccccccaacttcctactacttactttagactagttaacaaaccgtactctacgtacggtaccttcctacgaccgtcttctcgtacgtcctaccgtaacgtcgtcggaccgtaccgtacgaccgacccgtaaccgtacggaacctacgtaccgacccggtaacccttaccgaacggaccggtacgggggaaccggtacgggacccgttaagtttaccgttacgtacggaaccggaaactaggtagggaacttaccggaaacgtcctacgaggttaccggtccggttaggggttcgggttacgggaccggggtaaccggtaaaccgtaacggtaccgggtaacccggttaccggtacgggtaaccgacccgggtacccggtaacgggtcccgttacccgggtaccccccgttcgggtacccgttaccggttaccccgtttcccgggttaccccccgttaccccgttcccgttacccgtaccgtttaaccccggttccggttacccgttacggtcccggtaccgggtccgggtacccggg

SEQ ID NO: 266293 - DNA, 686 bp, Homo sapiens
  misc_feature: GYAE6OF02GCLXQ.23.80.H03.1.454.CMB.1.raw
  modified_base (200)..(200): a, c, t, g, unknown or other
  misc_feature (200)..(200): n is a, c, g, or t
  modified_base (268)..(268): a, c, t, g, unknown or other
  misc_feature (268)..(268): n is a, c, g, or t
  modified_base (419)..(419): a, c, t, g, unknown or other
  misc_feature (419)..(419): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtggcccagtctccattgacgcagccgccctcactttctgcggccccaggacaggcggtcaccatttccctgctcgggaancacctccaacattgggactcatggtgtttcctggtaccagcagatcgcaggaacacgcccccaattcncatctttgactagttaataaacgctctacaggtacctacctcgaccgtccttctctggcctccaagtctggctacgtcacgcccacctggacacgtccgaacccggtactaccgagtaccgtcgggggacgacggccgtaattacgttacncggacggaactagtagggaactaacgaacgtccctacgaggtcggtcggttgggttcgggttaccgggcggggtaacgggtaaacccaaaccggttccgggaacccggttccggtttacggggacctaacccgggtacccgaaacggtcccggtccgtaccccccgttgggtaccctacgttcccgttacccgttaccccctaccccgttcccgttacaccgtttaccgtcccgtaacgttccgtacggaccgggtcccggtaccgg

SEQ ID NO: 266294 - DNA, 863 bp, Homo sapiens
  misc_feature: GYAE6OF02HKEJ7.23.80.H03.1.454.CMB.1.raw
tcagacgcgagtatcacgaccggtgctcgatttagctgtgcgtcgaagggaaaggggacaatcttcatcatgacctgctccctctcctcctcacccttctcattcactgcacgagggtcgtcgggccagtctccattgacgcagccgccctctacttttctgccggccccaggacagggcggtcacctattttcctgcgtacgggaagccacctaccaactagttcgggacctcagttgggttcgttttccgtcggtaccagtcaaggtactccggacaacggaaaccaccgaccccccctaaactttcctacaacttcgttttacgaacctaagtttaaactaaaacgtactccgttacaacgggttaccttaccgtcgtacccggtctttaccgtcgttcggtccttaccgtaacgtccgtcgggacctaccggtaccgacgccctaacccgtaggaacctacgtaccgaaccccgggtaaccttacccgaacggtaccgggtacggggggaaccggaaccggggtacccgtttaacgttttaaacgtttaccgtacggggaacccggtaaacgtaacggttacgggggtaaactaaccgtaaacgtcccgttaaccggtacgggttcggggtacgtttcgggggttacggtttaccggggacgggtaacgggaaacccgtaacggtccggtaacccggttccggtacggggtaccgaccggtacccggtacggtaccgtcccggtaccccgttcggtaccgtaccgtttcccggttccgttaccccctacccttacccgttaccgtaactttacccggtcgggttcccgtttcgtaccgggtccgggaccggttcccggg

SEQ ID NO: 266295 - DNA, 569 bp, Homo sapiens
  misc_feature: GYAE6OF02FLZII.23.80.H03.1.454.CMB.1.raw
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
  modified_base (449)..(449): a, c, t, g, unknown or other
  misc_feature (449)..(449): n is a, c, g, or t
  modified_base (455)..(455): a, c, t, g, unknown or other
  misc_feature (455)..(455): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttcctgtcgctatttagaagctgtccagtgtgaggtgcaggtggtggagtcgtgggggagcctggtcagggcctggggatccctgagtaatttcctgtacactctctgaattcagtccttatacctggaacgtgggtcccnccgaggcctaccgaggggacggtcctagaggtcgggtctcgtccatcagtcgaagtctagttacttaaagtnttagtggtgggtctaggtggaagggcccgtnttacacctatcctcgaagacgacaaccgcaagaataccgactgtatcgtanactaancgaccagctagacgagcggagtacgaggtctattatcgtgtgtgagagtgacgagagagtacggttacggccgtacgccggacccgggtacctcggactaccgttcgtctaccg

SEQ ID NO: 266296 - DNA, 962 bp, Homo sapiens
  misc_feature: GYAE6OF02I5WLP.23.80.H03.1.454.CMB.1.raw
tcagacgcgagtatcacgaccggtgctcgatttagctgtgcgtcgaagggaaagggacaatcttcatcatgacctgctcccctctcctcctcacccttctcattcactgcacagggtcgtcggcccagtctccattgacgcagccgccctctactttctgccggccccaggacagggccggtcacctattttcccgtgccgtacgggaactccacctccaaactagttcgggaccttcagttgggttacgtttcccgtacgggtaacccaggcctaaggtactccggtacgaaacggttaaacccgaccggaaccccccccttaaaacgtttcctacccgtaacgtttcccgttttacggaaaccgttaacggtttaaacttaaaaaccgggtacccttacgttaaccgttaacggggttaccccttacccgttaccggtaacccgggttacccttttaccgttaccgttacgggtaccccgtttaccctaaaacggtttccggttacgggaccccgttaaacccgggttccgaaaacccggtcccccgtaaccccggttacgggtaacctaccgtaacccggtaacccggtaccgttacccgaacgtaaccgggtcgggggaaaccggtaccgggtaccgttaacgtttaccgttaacgtacggtaccggtaaaccgtaggtacgggtaacgtacgtaacggtaccgtacggtacggtcgggttacgttcggggttacgggtttaccgggacgggtaccgggtaaccgtaaaccggtacggttaacccggtaccgggtaccgggtaacggacccggtaacccgtaaccggtcccgttccgggtacccccgttccggtaccgttccgttacccgttcccggttccccggtcccttacccgtaccgttacccgtaaccggttcccggttaccgttcccgtcgggtaccggtaccggtaccggg

SEQ ID NO: 266297 - DNA, 612 bp, Homo sapiens
  misc_feature: GYAE6OF02HFUXV.23.80.H03.1.454.CMB.1.raw
  modified_base (301)..(301): a, c, t, g, unknown or other
  misc_feature (301)..(301): n is a, c, g, or t
  modified_base (381)..(381): a, c, t, g, unknown or other
  misc_feature (381)..(381): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtgggggaggcctgggtcagggcctgggggacgtccctgagtaactttcctgtacatcctctgaattcagttccttatcctggaactgggtccncaggctccgaggggagggcctaggagtgggtctcgtccatcagtcgaagcagttagtttaaagtattatggttcggggtnaggttggaacgggccgtacttcaccatcctccagacgaccaacgaccgaagaactacactgtatcgtagacaaagtcgaaccacgcctaggagaacggcgaggaccgacggggtattacgttattacgttgttggtagaagaggaagacggaggaggaggacggttaccggaccggcgaccgggaccccgggtacccggtacggtaccgtacccggttcttccgttacccg

SEQ ID NO: 266298 - DNA, 853 bp, Homo sapiens
  misc_feature: GYAE6OF02HAV12.23.80.H03.1.454.CMB.1.raw
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (301)..(301): a, c, t, g, unknown or other
  misc_feature (301)..(301): n is a, c, g, or t
  modified_base (420)..(420): a, c, t, g, unknown or other
  misc_feature (420)..(420): n is a, c, g, or t
  modified_base (453)..(453): a, c, t, g, unknown or other
  misc_feature (453)..(453): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagcccgccctcacttttctcgccggccccaggacaggcggtcacctatttcctgcgtcgggaanccacctaccaacngttagggactcattgggttcgtttccgtggtaaccagccagacgtccgacgaacggaaccaccgaccccccctaaacttccncctactttccgttgaacctaggtttaaacctaaacggtaccttaccgttactaacgggttaccctcccgttacggtaacccgtcctttaccgtccgttcggtcccttaccgaagtttcncgggtccaccgtcaccgcccacccgtagaaccnctaccgaccgacctaccgacgacgtcggggaacgtaccgggtacctagtttaacgtcgtacggtaacggtaaccggtagtaccgggtaaagtaacctaacggacccgttacggaacggggttcgttccgggtttaggggggttaccggttaccgggtaccgggggtaacggaaaacccgttaaaccggttaccggggtaacccgtacgggttcccggggtaaccgtaaccccgggtacccgtaaacccgggggcccctttacccggtaccccccgggtttccggtacccgttaacccctttccggttaccccctttcccccgggtacccctttacccgtacccttaaccgttacccgtcccggttaccggtttccccgtaagggcccgtcggggtaccgg

SEQ ID NO: 266299 - DNA, 872 bp, Homo sapiens
  misc_feature: GYAE6OF02GLXJF.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctcgctggttttcctgtcgctattttagaagtctgtccagtgtgaggtgcaggtggtggagtgtgggggagccgtggtcaggccgtggggactcccgtgagtaactttcctagtacactctctagtaattcgacgttccttaataccgtaggtaaccttcgggccgtaccgaggtcctacccggtaaggggaacgggtcccgttaaggaggttcggggtaccttccggtaccctaagtccaaacggttcgaaacggtcttaaacggtttaaagtttaaaagttatttacggttgggttagggggtaccaaagggttcggtaaaaccggggtccccgttacgttaccgaaacccttaagttccccgtaacggtacgaaacggtaacccgaaaccgggtaacccggaaacgtaaaccgttaaaccgtaacggttaaccggttaacgttcgttacgaaaccgtaaacgtaccgtaaccgtaacgtaacccgttacgggaaccggtaaaggccgggtaacgggaacgtaaccggggttaccgttaaagtttaaccggttacgtttacggttacggaaggtaacgggtaacgggaaggtaccgggaagggtaacgggtaacgggtaacgggtttacccgggaacccgggttacccggtaaaccccggggaccccggggttaaccccgttaccggggtaacccggaaccccggtttacgttaccccggttaacccgg

SEQ ID NO: 266300 - DNA, 809 bp, Homo sapiens
  misc_feature: GYAE6OF02HFRDO.23.80.H03.1.454.CMB.1.raw
  modified_base (154)..(154): a, c, t, g, unknown or other
  misc_feature (154)..(154): n is a, c, g, or t
  modified_base (721)..(721): a, c, t, g, unknown or other
  misc_feature (721)..(721): n is a, c, g, or t
tcagacgcgagtatcacgaccggtgctcgatttagctgtgcgtcgaagggaaaggggacaagtcttcatcatgacctgctccctctcctcctcacccttctcgacttcactgcacaggggtcgtgggccagtctccattgacgcagcccgcctntactttctgccggcccaggacacggcggtcaccatttcctcgctcgggaagccacctccaacagttgggactcgagttcgggttacgtttccgtcggtaacctagccgaaggtacttccggacgaacgggtaacaccggtaccccccctaaacgttccttacggaacttccgttttacgaactagttaacgtaaaccggtactcgttacgacggttaactccgtacgaacctcgttcctacgtggtcctaccgtaaagttcctacggtacctacgttacgacggcccctaacccgtacggaacctacgtaccggacccgggtactaccgtacggtaacggtcgggggaaccgacgggtaccgtttaactttaacgtttacgtcgggtaaccggtaaccgtaggtaacggggaacttaaccggtaacgtccctaggacggttcgggtaccgttaggggtttcgtaccggggacggtaaccgggtaacctaaacgttcgggacccgttcggtaggggttacccaacgggacccgtaagggtccctaccgggtcccccgttcggtacccncgtttaccggtcccggttacccctacccgttaccgtccgtaagtcccgttccgggtccgttaccgtacgggtcggtccggtaaccggg

SEQ ID NO: 266301 - DNA, 728 bp, Homo sapiens
  misc_feature: GYAE6OF02G0BQA.23.80.H03.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
tcagacgcgagtatcacgaccggtgctcgatttagctgtgcgtcgaagggaaaggggacaatcttcatcatgacctgctccctctccgtcctcacccttctcattcactgcacagggtcgtgggcccagtctccattgacgcagccgccctcacttttctgaccggccccaggacaggcggtcaccatttcctgctcgggaancacctccaacattgggactcatgtgtttccnggtaccnggcagatcgnaggacncgccccaactctcatctttgacctagttactaaacgaccttctacaggtacttccgtgaccgtacttctctacggctaccaaagttccgtaggtaccacgtcaacggcccacccgtaggaacctagtaccgaaccggactccaaggacccgttaggggggaaccgaacgggacccgtaagtttaacctttaacgtacgtaccgggaaactaggttcggggaataaaccgaaacgtccgttacctaaggggttcgggtaaaccggttgggggtacgttcccgggggacggggaaccgggtaaccaaaaccgtttccgggaaccccgttaccggttacggggaccctaggtacccccggaaaggtcccttaaccggccccccggtttaggacctaaccttccggtcggttaccccgcccttacccttcgaccgttaccttccggaccgtttcacgggtacgtcccgggtacgg

SEQ ID NO: 266302 - DNA, 842 bp, Homo sapiens
  misc_feature: GYAE6OF02HWUEA.23.80.H03.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagacgcgagtatcacgaccggtgctcgatttagctgtgcgtcgaagggaaaggggacaatcttcatcatgacctgctcccctctcctcctcacccttctcattcactgcacgagggtcgtgggcccagtctccattgacgcagcccgccctcactttctggccggccccaggacaggcggtcaccatttccngcgtcgggaancacctaccaactattgggactcagttcggttcgtttccgtaggtaccaggtccaggactccgacgtaacgggaaccaccggacccccctaattcctactacttctttgactagttaactaaacgtcttactactacggtaccttccgtacgaccgtcttcctcgtcggtctccgtaagttcgcgggtacctacgtacaccgtaccctacccgtaggacctacgtacccgaacccggtacctaccgtaacggtaccgggtacggggaaccggtaccggtaccgtttaaatttaccgttacgtacggaacccggtaaacgtaacgggtacgggtaaacttaacgaccgtacccgttacggtaacgggttcggtccgggtttcggggttacgggtttacccgggggacggggaaaccggggtaaacccgtaaacggttcccgggaacccggtttcccggggtacggtacccggtaaccggacccgtaaccggggtaccctccccgggttacccccggttacggttacccgtacccggttcccgtttaacccccggttcccccgtaacccggttcccttaacccgtaccttacccggttcgtacccggttaccgtttcgggaccgggtccccgggtacggg

SEQ ID NO: 266303 - DNA, 770 bp, Homo sapiens
  misc_feature: GYAE6OF02HRHY6.23.80.H03.1.454.CMB.1.raw
tcagacgcgagtatcacgaccggtgctcgatttagctgtgcgtcgaagggaaagggggagagaggagccttagccctggattccaaggcctatccacttggtgatcagcactgagcaccgagcttcacatggaactggggctccgctggtttccttgtcgctattttagagctgtccagtgtgaggtgcaggtggtggagtcgtgggggaggcctgggtcaggccgtggggacgtcctggagtaactttcctgtacatcctctagtaattcagttccttataccgtaggaaccgtcgggcccgtccgacggctccgagggacgggccgtaggaggtcgggtctccgtaccatcgacgtacggaagcgtaaggttaaagttttaaaagtatttaagtgggttaggggtactaggtagggaaacggggcccgtaccttaccgaaccctaacgttcccgacccgtaaggaacgaaaccgaacccgggacccggtaaagtaaactaaccgtaccgttaagttacttacgtacgaaactaaacgtaccgaaaccgtacgacccgttaagggaacggtaaacggaacccgggaagggtaacccggtaaaggggttacgtaaagtttacgtttaacgttagggttcggtaaggaaagggacgggtagaccggaaggggtaagaacggttccgggttaacggcccgggtaaccgacccgggtaaccccgggggtacccgtaccgggttacccgtaacccggttcgtcccgttaaccgg

SEQ ID NO: 266304 - DNA, 780 bp, Homo sapiens
  misc_feature: GYAE6OF02IA6N5.23.80.H03.1.454.CMB.1.raw
  modified_base (694)..(694): a, c, t, g, unknown or other
  misc_feature (694)..(694): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctaccgcttgggttttccttgtcgtctatttttagaagcttgtccagtgtgaggtgctagggtggtaggagttcggtaggggggacggccttgggtcacgggtcccgtgggggacgttccccgtaggaacgttaacgttttcctaggttaccagttccgtcttaggtaactttccgtaacggtttcccttaattaccggtaggtaaccggttcggggtacccaccgacgggtccttaacccgggaaggggtaacccgggggtccttaagggtccggggttcggggttcctaccggtttaccacgttcgacggttcgaaaacgtcgtaagtttaaagtttaacgttagttaacgttcgggtaggggtttaccagggttacggaacgggtcccacgtttaccaaccgtctcgtaacccggaggtaactaacccgaaccgcgtaagaaccttacggacgttagttactcgtagaacgtaacttcggacccgtagtacgcggtaagaacggcagggtaacgtacgggtagttacgtacgttgtagtcgataaccggnggtaacgacgacgggtagcggtaacggttcgaccgtcggaccccggtaccggtaccggtccgtcgtaccgtccgtttcgtacccgg

SEQ ID NO: 266305 - DNA, 723 bp, Homo sapiens
  misc_feature: GYAE6OF02JPK8R.23.80.H03.1.454.CMB.1.raw
tcagacgcgagtatcacgaccggtgctcgatttagctgtgcgtcgaagggaaaggggacaatcttcatcatgacctgctcccctctcctcctcacccttatcattcactgcacagggtcgtgggcccagtctccattgacgcagccgccctcactttctgcggccccaggacaggcggtcaccatttcctgctcgggaagcacctccaacattgggactcatggtgtttcctgggtaccagcagactcgcaggaaccacgcccccaagttccactactctttagactagttaataaacgctctcaggtacctcctagacctcttctactcggccttccgaacgttcgtcgggtactaccggtctacggccctaccgttcggaactctaccgaacccggcctccgaggtaccgtaggggggaaccgacggtaccgtaacgtttacgttaaccgtacgggaccggtaaacgtacggtacggggaattaaccgaaccgtaccgtactaagggtcggtcgttagggggtcgttaccggggacgggtaacggggaacccgtaaacgtcgggttaaccccgtacgggttacgggtaccgacggtacccgtaaggccgtacccggtccccgtccgggtactacccgtccggttccggttaccccgtccccgttaccgtaccgtacgttaccggaccgtccgttacggtccggtaccgggtaccggtccgg

SEQ ID NO: 266306 - DNA, 850 bp, Homo sapiens
  misc_feature: GYAE6OF02FKDUL.23.80.H03.1.454.CMB.1.raw
  modified_base (208)..(208): a, c, t, g, unknown or other
  misc_feature (208)..(208): n is a, c, g, or t
  modified_base (290)..(290): a, c, t, g, unknown or other
  misc_feature (290)..(290): n is a, c, g, or t
tcagacgcgagtatcacgaccggtgctcgatttagctgtgcgtcgaagggaaaggggacaatcttcatcatgacctgctccctctcctcctcacccttctcattcactgcacagggtcgtcgggcccagtctcctattgacgcagccgccctcactttctcggccggtcccaggacaggcggtcacctatttcctgacgtcggggaanccacctaccaactagttcgggaacctcattggttcgtttccgtacggtaccagtacaggtactccggacgaacgggtaaccnccggaccccctaacttcctactacgtttactttacgaacgtaacgttttaaacgtaaaccggtaccttccgttaacgtaacggttacccttccgtaaccggtaccccgttactttaccgttcgttccggtaccgttaaccgtaacggtttcgtacgggtacctaacgtccgaccgtaccccgtacccgtacggtaaccgtacgttacccggaaccggtccttaacccggacgggtaaccgggttacggggggacgttaccggggtaaccgtttacgtttacctttaccggacgggtaaacgtaacggtaggttaaccgggtactaaccggtaaccggtccgtaaccgttagggtccggttacgggttcgggtttccgggttacgggaacgggttaaccggaaccgtaacggttccggaccggttcgttacgggactaccggtaaccgtacgtccgtaccgtcccgtacggtcctaccggtacgttcccggtacccggccttacccgttaccgttactacccggttcgtacccgttcggtacggtccgggttaccgtacgg

SEQ ID NO: 266307 - DNA, 942 bp, Homo sapiens
  misc_feature: GYAE6OF02IXY60.23.80.H03.1.454.CMB.1.raw
tcagacgcgagtatcacgaccggtgctcgatttagctgtgcgtcgaaaggggaaagggggagagaggagccttagccctggattccaaggcctatccacttggtgatcagcactgagcaccgaggcttcaccatggaacgtggggctccgcgttgggtttttccttggtcgtcttattttaagaagtcttgtccagtgtgaggtgcgagggtgggtggagttcggtggggggacggccgtgggtcgacgggccgttagggggacgttccccgtaggaacgtaacttttccgtaggtacctacttcccttacgtagtaaactttccaacgtttaccctttaacgttacccgttaggtaaaccggttcggggttccccgaccgtacgggtccgtacccgggaagggggaacggggtaccctaagggtacgggttcggggttccttccggttacccgtattacccgtaacggtaccggaaacgtcgttaaaggtttaaaggttttaaaaagttggtttaacgttagggggttacgggggtttacgtaagggttacggggtaacgggtccccgttaccgtttacccgaaaccctacgttccctaacccggtaacgaacggaaccgaaaccccggtaccgaaacggtaaacttaacgtaacgttacgttaacgttaccgtacgtaaactaaacgttaccgaaaccgtacggtaccgtaaggaaacggaccggaacgggtaaccggaaccgggtaacggggtttaacgtttaaagtttaacgtttaaccggttggttaaggtacgggaaaggtaaggggaacgtaacggaaggtaacggggtaacgttaccgggttaccgggacccggtacccggtaaaccccgggtaccccggggtaacccggttccgggtaccccgtacccggtttaccgtacccggtttacccgg

SEQ ID NO: 266308 - DNA, 712 bp, Homo sapiens
  misc_feature: GYAE6OF02FTAQG.23.80.H03.1.454.CMB.1.raw
  modified_base (191)..(191): a, c, t, g, unknown or other
  misc_feature (191)..(191): n is a, c, g, or t
  modified_base (242)..(242): a, c, t, g, unknown or other
  misc_feature (242)..(242): n is a, c, g, or t
  modified_base (537)..(537): a, c, t, g, unknown or other
  misc_feature (537)..(537): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcacgtttctgcggccccaggacaggcggtcaccatttccngctcgggaagccacctaccaacattgggactcatggtgtttcctggtaccngtcagatcgacaggaaccacgccccccaattcctacactcttttgactagttaactaaacgaccttactctaggtacctcctcgtaccgtcttctaccgtggcctccgtaagttcgtacgggcctaacggtccaccgtcccgtaacccgtcggaactacgtaccacccgggtacctccgaacgtacggacgggggaaccgacgggtccgtaattacgttacgtcggaacgaacaggttacgggaacttaacgactcccgtagaacggttcggtcgtcgggtttcggtaccggggngggtaaccggaaaccgtaacgtcgacccggtccgtacgggtccgaacggtacccaagggtcctcccggtaccccgtccggtactaccgttccgtttcccgtcccccgttacccctcccgttaacgtaacccctacgttcccgtaccggttccgtacgggttccggcggtaaccgg

SEQ ID NO: 266309 - DNA, 804 bp, Homo sapiens
  misc_feature: GYAE6OF02GD2WW.23.80.H03.1.454.CMB.1.raw
  modified_base (344)..(344): a, c, t, g, unknown or other
  misc_feature (344)..(344): n is a, c, g, or t
  modified_base (595)..(595): a, c, t, g, unknown or other
  misc_feature (595)..(595): n is a, c, g, or t
tcagacgcgagtatcacgaccggtgctcgatttagctgtgcgtcggaaggggaaagggggagagaggagccttacgccctggattccaaggcctatccacttggtgatcagcactgagcaccgaggcttcaccatggactggggctccgcgttgggttttccttgtcgcttattttagaagctgtccaggttgtgaggtgcagggtggtggagtcggtgggggacgccgtgggtcagggccgttgggggactcccgtggaagtacttttccgtagttacacgttccctctagtaactttcgacgttaccttaatacccgttacgggacgttccggggtaccccnccgacgggtcctacccggaagggggtaacggtcccgtaaagggacgggttcgggttcccgttccggttacccaaggttccgtagggttaccggaaacgccggttaaaggggttttaaagttttaaaacggttatttacggtgggttagggggtcctaaggggtacgggtaacgggccgttacttacgaacctagtcctaccgagaacgaaccgaaccgtacggaacaacgttacacttagttactacgtanaacgtaatcgaccgtacgcgtagagaacggtcgggaacggacggtaacgggttcgttaattacgtacgttcgggttaagacgtaaagggacggaagaccggtagggaacggtacgggtaaccggttccggaacccggtacggaacccggtaccccggggttaacgttcccgggtaaccctacccggttcccggttaccggttaccccgg

SEQ ID NO: 266310 - DNA, 828 bp, Homo sapiens
  misc_feature: GYAE6OF02GIMRW.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgccggccccaggacaggcggtcaccatttcctgcgtacggacgcacctccaacattgggactcatggtcgtttcctggtaccagcagactcgacgaaggaacaccgaccccccgaacttcctcgtaacttctttacgactaacgtttaataaacgacttctacgaacggttacctccgtacgtacccgtcctttaccgttccttcgggtcccttacccgtaaacggttccgttacgggtaccgtaaccgtcgtaacccgaccccgtacccggtacgggtaactaacgtacccgtaacccggtacctacccgtaacggaccgggttacggggaaccggaccgggtaacccgtaacgttttaccgttacgtacgggtaacggaaacctagggtacgggtaaactaaccgaacgtcctaacgacggtcgggtacggttgggttcggttcggggaccgggaacggtaaaccaacggttcggacccgtttacccgggtagggtacccaccggggtaccccgtaagggtccccgtacccggtccccgttaccgggttccaacccgggtttcccgttaaccccggttcccccgttccccgttacccttaccgacccgttttaccccggtccggttcccgttacggtaacccgggtaccgggcccggtttaccgggg

SEQ ID NO: 266311 - DNA, 646 bp, Homo sapiens
  misc_feature: GYAE6OF02G9YWZ.23.80.H03.1.454.CMB.1.raw
  modified_base (370)..(370): a, c, t, g, unknown or other
  misc_feature (370)..(370): n is a, c, g, or t
  modified_base (401)..(401): a, c, t, g, unknown or other
  misc_feature (401)..(401): n is a, c, g, or t
  modified_base (480)..(480): a, c, t, g, unknown or other
  misc_feature (480)..(480): n is a, c, g, or t
tcagacgcgagtatcacgaccggtgctcgatttagctgtgcgtcgaagggaaagggggagagaggagccttagccctggattccaaggcctatccacttggtgatcagcactgagcaccgaggcttcaccatggaactgggctccgctgggttttcctgtcgctattttagaagtctgtccagtgtgaggtgcaggtggtggagtcgtgggggagccgtggtcaggtccgtggggacgtccctagagtacttcctgtacactcctctagtaattcagtccttatacctggaacctgggtcccgcaggcctccgaggggaggcctaggagtgggtcctcgtccatcgagtcgaagctagttagttaaagtnttatggtggggtacaggtaggaacgggtccnctttaccgaaccgtatccgacctagacgtaccgaacgccgaagaactacctaacgtgtattcgagactaatacgaaccngccagggaacgacggcgaagggaccgacgggttatacgttacgttacgtgttaggtacgaggtaacggagacggaaggacggtaacgggtacggttccgggacccgcgtaccgggacccccgggtaccgttcggaccccgtaaccgggttcccttaccgtacccgg

SEQ ID NO: 266312 - DNA, 782 bp, Homo sapiens
  misc_feature: GYAE6OF02F7P8A.23.80.H03.1.454.CMB.1.raw
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagcccgccctcactttctgccggccccaggacaggcggtcaccctatttccgtcgcgttcgggaacgcacctaccaacagttgggactcctagtggttcgttttcccgtaggtaaccacgcagtactccgacgaacggaacaccgaccccctaacgttcctctacttacgtttgaccgtaagttaactaaaccgacttctacgtaacgtacctccgtcgaccgtcttcctacgtcggtccgtacctaagttccgtcggcctacgtccgaacgtcccgaacccgtacggactaccgtaccggacccggacctaccgaacgtcggtacggggacgtacggaccgtatttaccgtacgtacggtacgaacgtacggtgggtaactaacgtaacgtaccctacggacgttacgggcgttcggggtacgttacggggacggaaaccgggaaccgtaaacgttccggtacccgggttaccgcgggttaccggaaccggtacccgtaacgggtcccgtacccggaccccccgttacggttacccgtaccgtttccggttacccgtttcccccgtacccccggttacctaccgttaaccttacccggtccgttcccggttaccgaccgggtcgggtccgggtacccgg

SEQ ID NO: 266313 - DNA, 772 bp, Homo sapiens
  misc_feature: GYAE6OF02G7ARH.23.80.H03.1.454.CMB.1.raw
  modified_base (161)..(161): a, c, t, g, unknown or other
  misc_feature (161)..(161): n is a, c, g, or t
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
  modified_base (730)..(730): a, c, t, g, unknown or other
  misc_feature (730)..(730): n is a, c, g, or t
tcagacgcgagtatcacgaccggtgctcgatttagctgtgcgtcgaagggaaaggggacaatcttcatcatgacctgctcccctctcctcctcacccttctcattcactgcacgagggtcgtgggcccagtctccattgacgcagccgccctcacttttcncggccggccccaggacagggcggtcacctatttccngcgtacgggaagccaccctccaactagttgggactnagttggttcgtttccgtaggtaccaggccagtacgccgacaaggaaccaccggacccccctaacttcctactactttctttcgtaacttaagttaaactaaaccgtactaccgtaccgtaaggttaccctccgtaccggtacccgttaccttccgttccgtccggtacctaccgttaaacggttccgttacgggccgaaccgttacgacccggtacccctaacccggtacggaacctaccgtacccgaacccggtacccgtaaccgacgggtaacggtacggggggaaccggtacggtaccggttactttaaacggtacggtacgggaaaccggtaacgaggttacgggaaactacgtaacgtccgtagtacggtagggttcgttcgggttacggttcgggaacgggacggtaaccggtacgtaccgggtccgttcggacgtccgaacgtccgacggtccgcccgtcccgtcggtcctccgttccgccggttccccnccgtacgccttacgtcgtccgtccgtgacggtccggtcgcgg

SEQ ID NO: 266314 - DNA, 795 bp, Homo sapiens
  misc_feature: GYAE6OF02GTRGK.23.80.H03.1.454.CMB.1.raw
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
tcagacgcgagtatcacgaccggtgctcgatttagctgtgcgtcgaagggaaagggacaatcttcatcatgacctgctcccctctcctcctcacccttctcattcactgaacagggtcgtggcccagtctccattgacgcagccgcctcactttctgccggcccaggacaggcgtcacatttccngctcggancacctcaactattggactcagttcggtgtttcctaggtaccagcagactcgacaaggaaccacgaccccctaacttcactatcgtttacgactagttaataaacgactctacgacgttaacctcgtacgtaccgtcttactcgtacggtcctaccgtaagtctacggcctaacggtccaacgccccgtaaccgtaggaacctacgtaccgtaaccggacttaccgaacggtaaccgtagggggaacgacgggtaccgtaatttaacgttaacgtacggtaacggaaacgtaaggtacgggtaaactaaccgtaaacggacccttaaggtaacgggtccggttacgggttacggggtttcgggttaacccggggaacggggtaacccgggaaacccgtttaaaaccgccgggttaaccccgttaacgggtcgggtaaaccctccgggaaacccgtagggtaccccgttcccggccccgtttacgggtactacccgtttaccgttacccgttaaccccctacccttacccgttaccgtaacctttacccgggtaccgttaccggtttcccgaagggtcccggtaccggggttaccgtaaccggg

SEQ ID NO: 266315 - DNA, 872 bp, Homo sapiens
  misc_feature: GYAE6OF02HV16C.23.80.H03.1.454.CMB.1.raw
  modified_base (160)..(160): a, c, t, g, unknown or other
  misc_feature (160)..(160): n is a, c, g, or t
  modified_base (174)..(174): a, c, t, g, unknown or other
  misc_feature (174)..(174): n is a, c, g, or t
  modified_base (192)..(192): a, c, t, g, unknown or other
  misc_feature (192)..(192): n is a, c, g, or t
  modified_base (204)..(204): a, c, t, g, unknown or other
  misc_feature (204)..(204): n is a, c, g, or t
tcagacgcgagtatcacgaccggtgctcgatttagctgtgcgtcgaagggaaaggggacaatcttcatcatgacctgctcccctctcctcctccacccttctcattcactgcacagggtcgtgggcccagtctccattgacgcagccgccctcactttcngcggccccaggacnggcggtcacctatttccngcgtacgggaanccacctcaaactagttcgggactcattgggttactttcctcggtaccagctaagactcgacgaacggaacaccggacccccctaattcctactacttctttacgaaccgtaagttaactaaaaccgtacttacgtaccgtaacggttaccttaccgtacgtaacccggtcttttcctacgtcgggtaccctaaccgtaacggttactcgggacctaacggttccaacgtccctaccgttacggaccacgttaccaaccgggacctaccggacggtaccggtacggggaaccgtacgggtacctaagtttacctaacgtacggaccggtaaactacggtaacggtactaaacgaaccggtcccgttaacgtacgggttccgggtaccggtttaggggttacgggttccgggaaccggggtaaccggggaaaacccgtaaacgggttcccggtaaaccccggggttaccggtaccggggttaaccgtaaccggtaaccccgttaaaccggggtcccggttaacccccggtccccggtttaacccgggttacccgttaaacccggtcccggttttaaccccggaccccctttaaccccgtcccgttaacgtaacccgtttcgtcccggttaaaccggttcccggtacggttaacccgggccggtaaccggg

SEQ ID NO: 266316 - DNA, 747 bp, Homo sapiens
  misc_feature: GYAE6OF02I48H2.23.80.H03.1.454.CMB.1.raw
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (325)..(325): a, c, t, g, unknown or other
  misc_feature (325)..(325): n is a, c, g, or t
  modified_base (397)..(397): a, c, t, g, unknown or other
  misc_feature (397)..(397): n is a, c, g, or t
tcagacgcgagtatcacgaccggtgctcgatttagctgtgcgtcgaaggggaaaggggacaatcttcatcatgacctgctcccctctcctcctccacccttctcattcactgcacacgggtcgtcgggcccagtctccattgacgcagccgccctctactttctgccggaccccaggacaggcggtcacctntttccagctacgggaacncacctcaacngttggctcatggtgtttccagtaccagctagatcgactagaacncgaccccctaattcncattcttacacaagttactaaacgctacgtctaacggtcctccgtntccgtcgttcctcgtcggtcctacccgaagttcgtcggactcgtacgctcctacgtacgtcggactctaccncggaccttccgaacggtactcgggggactacggtacctagttacgttactacggacccgtaaggtacgtacgggtaaactacggtaacgtaaccgtgtaaccgggtacgggtttcgtcgggttacgggtttaccgggaaacggggttacggaaaacccggttaaacggttcccggggtaacggtttccccgggtaaccggggttaacccgaaccgggttaacccgaaggttcccggaacccggtttcccccgtacggtaatcccggttaccgttacccgttacccctaacccggttaccctacctaccggttaccgccgttacccggtccggttacggaaccgtccgggg

SEQ ID NO: 266317 - DNA, 913 bp, Homo sapiens
  misc_feature: GYAE6OF02JUN6S.23.80.H03.1.454.CMB.1.raw
  modified_base (171)..(171): a, c, t, g, unknown or other
  misc_feature (171)..(171): n is a, c, g, or t
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (485)..(485): a, c, t, g, unknown or other
  misc_feature (485)..(485): n is a, c, g, or t
  modified_base (879)..(879): a, c, t, g, unknown or other
  misc_feature (879)..(879): n is a, c, g, or t
tcagacgcgagtatcacgaccggtgctcgatttagctgtgcgtcgaagggaaaggggacaatcttcatcatgacctgccttcccctctcctcctcacccttctctattcactgcacgagggttcgcgggcccagtcctccattgaccgctagcccgccctctacttttcgngcccggcccaggacctagggcggttaccaaccnctttcctgaccgtcgggaacgcctacctacaatagttcggggacctagacgttcgggtttcttccgttaggtaccaggtcacgtagtaccggngaaacggaaccccgaccgtaccccccttaaactttccgtactacctttcgtttacggaaccttaaccggtttaaataaaaccccggtacttccgttacggtaaccggttaaccccgttcttaacccccgggacgttaccctttttaccgtcccgtcgggttaccctaccgtaaaccggtttacccggnggttaccgaccgggttacaaacggttcccctaaccggtaccggaaacttcctaaccccggtacggtacccgtacgttaacgggacccgggttagggggaacccgaggttaacccgtaatttaaccgttcgggtaacccggaacggtttaacgaggttaccgggaataaccgtacggttaaccttcggagttaaccggggttcggtttacgggtacggtacgggaccggtaacgggtaaccggtaacgtccggaccggttccggttacgggaccgtaccggaccgggaacccggttcgtacccccgggttacgggtttaccggtccttaaccgttcccggtttaaccccgtccgtacccttaacccggttccgtttaacgccggttaaccccggnggtttaccgacggggtttcccgtaccgggtccgg

SEQ ID NO: 266318 - DNA, 831 bp, Homo sapiens
  misc_feature: GYAE6OF02HQUH1.23.80.H03.1.454.CMB.1.raw
  modified_base (322)..(322): a, c, t, g, unknown or other
  misc_feature (322)..(322): n is a, c, g, or t
tcagacgcgagtatcacgaccggtgctcgatttagctgtgcgtcgaagggaaagggggagagaggagctagcctggattccaaggcctatccacttggtgatcagcactgagcaccgaggcttcaccatggaactggggctccgcgtgggttttccttgtcgctattttagaagctgtccagtgtgaggtgcgaggtggtggagtcgtgggggaggccgtggtcgaggccggtggggacgtcctggagtaacttctgtacatcctcgttagaacttcacgtacctttagtaccgtaggtaaccgtcggggttccccgaccgnggacccgtcccggaagggggtaagggacccttaaggagggttccggggtcccctaccgtaccgtacgtacggtaggtaccgaacgtaacgtttaaggttttaaaaaggttaacgttttaagtcggttgggggttacggtaaggtacgggtaaccggggacgggttcccttaccgttacgtaacctaccgttaccgggtaacaagggttaaaccgaccgaaacccggggtaacgtaaaacgtaaaccgttaccgttacggttaattaccgttacgaacccgtaaaagttaaccggacaaacccggttcggaaccaaagggtaaaggaccgtaacgggaaaccgggtacggtagttaaccgttaaagttcggtttagtagggtcggtaaagggaaccggttacggaaacgtaggggtaaggaaggtccgggttaaccgggcccggaaccggggtaaccgccccgggaaaccgggttccggtaccaaccccggtttctccggttacgacccg

SEQ ID NO: 266319 - DNA, 770 bp, Homo sapiens
  misc_feature: GYAE6OF02GAO2Q.23.80.H03.1.454.CMB.1.raw
  modified_base (199)..(199): a, c, t, g, unknown or other
  misc_feature (199)..(199): n is a, c, g, or t
  modified_base (256)..(256): a, c, t, g, unknown or other
  misc_feature (256)..(256): n is a, c, g, or t
tcagacgcgagtatcacgaccggtgctcgatttagctgtgcgtcgaagggaaagggggacaatcttcatcatgacctgcctccctctcctcctcacccttctcattcactgcacaggggtcgtgggcccagtctccattgacgcacgcccgccctctactttctggccgccccaggacacggcggtccacctatttccngcgtacgggagccacctcaactgttggactcagtggttcgttcctggtaccagcagntaccggacaggtaaccaccgaccccctaacttctactacgttacttttacgaccttaagttaacgtaaacgtccttacgttaccgtacggttaaccttccgtacgttacccgttccgttacttcggtacggtccctaccgtaacgttccgtacgaccgtacctacgtaccgtccctaccgtacgacctacgttccgacccgtacctacgacggtacggacgggtacgacggtaccctagtttcgtacgtacgaccgagtaggtcggaatacgacgtccctaggacgttcggacggttacggttacggtccgggtaacggtaaccggaacgtaaccgtacccggagtttaccggacggtaccgaccgtaccgggacgttccggtacccgttccgggaccgttacccgacctttacccgggtcccttaaccccccgtaccgtcccgtttaacccgacggtttccccctaccgggtacccggttacgacccgggtaccgggtcccgggtaacccggg

SEQ ID NO: 266320 - DNA, 710 bp, Homo sapiens
  misc_feature: GYAE6OF02H4F9I.23.80.H03.1.454.CMB.1.raw
  modified_base (159)..(159): a, c, t, g, unknown or other
  misc_feature (159)..(159): n is a, c, g, or t
  modified_base (167)..(167): a, c, t, g, unknown or other
  misc_feature (167)..(167): n is a, c, g, or t
  modified_base (210)..(210): a, c, t, g, unknown or other
  misc_feature (210)..(210): n is a, c, g, or t
  modified_base (468)..(468): a, c, t, g, unknown or other
  misc_feature (468)..(468): n is a, c, g, or t
  modified_base (531)..(531): a, c, t, g, unknown or other
  misc_feature (531)..(531): n is a, c, g, or t
tcagacgcgagtatcacgaccggtgctcgatttagctgtgcgtcgaagggaaaggggacaatcttcatcatgacctgctcccctctcctcctccaccttctcacttcacgtgcacgtagggtcgcgggaccagtctccagttgacgcacgtccgccctntactttcncggccggcccaaggacctagggccgtaccaccgtagttttccngtccgacgggaatccaccgtacactaggtgactctagtggttcgttctaggacagcgagtactgacaggtaaccacgaccccctaatcgtactacgttactttcgaacttaagttaacgtaacggtacctcaacgttacggtacctacgtaccgtacgtcgtttccgtcgttcggtacctaacccgttagtacgttacccggagttaccgcgaccgtaccgaaccggtagtaccacgtcgtaccgctacgacgtacgnggggaactccggtagtactttacgacgtacggtacgaacgagtacggataccggacgttaccncggtagtcggtacggtacggcgggtcgaacgggtaccggaactaaaccgtccgggacggacgtcggacacgtaccgacggtctacccggtacctcgtaccgtaccggtttcgacccggttaccgtcccttacggtaactccgtacgtccggtacctacggtacggacggccgttacggg

SEQ ID NO: 266321 - DNA, 645 bp, Homo sapiens
  misc_feature: GYAE6OF02GO7VI.23.80.H03.1.454.CMB.1.raw
  modified_base (189)..(189): a, c, t, g, unknown or other
  misc_feature (189)..(189): n is a, c, g, or t
  modified_base (210)..(210): a, c, t, g, unknown or other
  misc_feature (210)..(210): n is a, c, g, or t
  modified_base (284)..(284): a, c, t, g, unknown or other
  misc_feature (284)..(284): n is a, c, g, or t
tcagacgcgagtatcacgaccggtgctcgatttagctgtgcgtcgaagggaaaggggacaatcttcatcatgacctgctcccctctcctcctcacccttctcattcactgcacagggtcgtgggcccagtctccattgacgcagccgccctcactttctgcggccccaggacaggcgtcaccatttccngctacgggaagcacctccaanattggactctatggttcgtttcctggtaccagcagactcgacaggaacaccgacccccacttctacattcttanactagttaactaacgtactctacagtacctcctcgaccgtcttctctcgcctactagtctcggcacgtcaccgccaccgtggaactacgtaccgaacccggactaccgagtacgtacggggacggacggtaccgtaattacgtacgacggaacggtaacagtaggtaactaacgacgtcccgtgaaggttcggtcggtagggttcggttacggacgggaacggtaaccaaacggtcggacccgttcggtcgggtaacaccggaacccaagggccctacccgtccccgtagtaccctcttccgttcccgtccccgccctaccgtctaaccgttcgtccgtaccgtcgtagccgggcgtaccg

SEQ ID NO: 266322 - DNA, 816 bp, Homo sapiens
  misc_feature: GYAE6OF02FP8LF.23.80.H03.1.454.CMB.1.raw
  modified_base (307)..(307): a, c, t, g, unknown or other
  misc_feature (307)..(307): n is a, c, g, or t
  modified_base (752)..(752): a, c, t, g, unknown or other
  misc_feature (752)..(752): n is a, c, g, or t
tcagacgcgagtatcacgaccggtgctcgatttagctgtgcgtcgaaggggaaaggggacaatcttcatcatgacctgctccctctcctcctcacccttctcattcactgcacaggggtcgtgggcccagtctccattgacgcagccgcctcactttctcggccggccccaggtaccgagggtccgggttacaaccgtattttacccgtcggtcgtaccgggggaagtacctaacctacccaaactaacgtttcgggggaacttccaagttcgggttcgtttacctcggtaccagctaagactcganacggacacgcccccacttctctatcgtttgaccgtaagttaactaaccggtacctacgttacgtaacggttacctaccgtgacccgtcttaccgttcgtacggtctacctaagtccgttacgaccgtcgtacgtacgacccgaccgttacgggaactacgttaccgaaacccgggtaccgtacccggtaacggaccggggtttaacgggggaaccggtaccgggttaccgtaacgtttaacgtttaccggttaacggaaccgggtaaacctaacgggtacgggttaacgtaaacgttaaccgaccggttaaccgtacggtgggttaccgggtagggtttaccggttaccgggggtaaccgggaccgggtaaacctaaccgtacggtacccgggtacgtacgggttaccgacgacccgtaacggccgttacgacccctggttaccncgtccgttacccgtcctaccctcggacttactacccggtctccggtactcggaccgtcggtacg

SEQ ID NO: 266323 - DNA, 760 bp, Homo sapiens
  misc_feature: GYAE6OF02FZNS0.23.80.H03.1.454.CMB.1.raw
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
tcagacgcgagtatcacgaccggtgctcgatttagctgtgcgtcgaagggaagggggagagaggagccttagccctggattccaaggcctatccacttggtgatcagcactgagcaccgaggcttcaccatggaactgggctccgctggtttccttgtcgctatttganctgtccagtgtgnggtncgaggtggtggagtcgtggggggagccgtggtcacgggccgtggggactcccgtgagaactttcctgtaccagtcctcgtgtaacttcgagttccttaactaccgtggtaacctcgggtcccgacgaggtcctacggagggtaaccgggcctaggagttcgggtctacggtccagtcaggtcgaaggcagttacgttaaagtcttagtacgggtggggtactaggttacggaacgggtcccgtattacccgacgtacgtacccgtacgtaacggacgaaaccgtaccggtaccgaaaggtaaccgtaacgtacgttacggtaaacgtccgttaacggaaccgtaaacggttcgaacccggacgtaccgttaaggaacggaaacgggtaccggaaaggggaccgttaaacggggttagtaaacctttaacggtttaaccgtggttacgtaacgggtaacgaaggggtaacccggtagaacgggtaaggtaacgggtacggttaccgggccccggtaagacccgggtaccccggaacccggttccggtaaccggtcccgtccgttaccggtaaccg

SEQ ID NO: 266324 - DNA, 606 bp, Homo sapiens
  misc_feature: GYAE6OF01BOHS2.45.84.H07.1.454.CMB.1.raw
  modified_base (98)..(98): a, c, t, g, unknown or other
  misc_feature (98)..(98): n is a, c, g, or t
  modified_base (202)..(202): a, c, t, g, unknown or other
  misc_feature (202)..(202): n is a, c, g, or t
  modified_base (237)..(237): a, c, t, g, unknown or other
  misc_feature (237)..(237): n is a, c, g, or t
  modified_base (502)..(502): a, c, t, g, unknown or other
  misc_feature (502)..(502): n is a, c, g, or t
tcagacgcgatcgacacgaccggtgctcgatttagcagacgtctgtcgcgggggagtcagacccagtcaggacacagcatggacatgagggtccccgntcagctcctggggctcctgctgctctggctcccaggtgccaaatgtgacatccagactgacccaatctccttctaccctgtctgctatctagtaggacgacagngtcaccatcacgttcgccggaccagtacaaagttnttagtgacgttggtggtcctggtatcgaggaccaacggaaaccggggaaacgccccgttaaggtcctaggatccgtacgagggtccgtatagtactaagggtaaaggtcggggtcgacccgaacgtaaggttcacggcggtcaggtgagtacggtaggacaagtacttacacgtctacaccacgtacacgcgagccgtcgctacgtcgtgtatgttatttacgacttaaccttactctacgactaagtaacgttgttaagttttntacggtacgttcgacggtaaggacggaaggtacgaaactacgtaaaccgagtacggtacgactggaccatacgttacgcgttacttaccgcttcccgtcctacg

SEQ ID NO: 266325 - DNA, 823 bp, Homo sapiens
  misc_feature: GYAE6OF01AXK31.45.84.H07.1.454.CMB.1.raw
  modified_base (99)..(99): a, c, t, g, unknown or other
  misc_feature (99)..(99): n is a, c, g, or t
  modified_base (119)..(119): a, c, t, g, unknown or other
  misc_feature (119)..(119): n is a, c, g, or t
  modified_base (803)..(803): a, c, t, g, unknown or other
  misc_feature (803)..(803): n is a, c, g, or t
tcagacgcgatcgacacgaccggtgctcgatttagcagacgtctgtcgcgggggagtcagacccagtcaggacacagcatggacatggacgggtccccnctcagctccgtgggctcctnctgctcgtcggcctcccgaggtacgacctaaagtgtacgacatccgagtactacgaaccctaacgttccttcccgtttacctacccgttggtcctgcctagttcgtagggtagagacctaggtactaccacctactctaccgttcgggcccggtactagtaccgtaagttagttacgaggtacgtttgggtccgtcgttacggtctacggtacgaaccggaacggggaaccggtaaccgtcccggtagtctacgtcgtaccggtacggtccgggttactacgtacggtacgtagggtaccggttacggggcctaaccggtaaccggttacggtaccggccggtacggaccggttaaggtcggttacgtaccgggtacgggtaacctaacggttaacccttaccggttaccctacccgtttaaaccgcgttaaacgtcccgggtacgtacccgttacgggttacccgcgttaaccggtcgtacccggtttaggttactttaccggtttacgtttaaccgttacccgttttaactacccggttttaccgtacctaaaccggtttaagttaacggttttacggtttacgtttaacgggttaccggtaccggttacgggtaacgggtaggtaccggtaaggtaaccgtacgtaacgacggtaccgtgacgtcacggtcccatgttctnttcctgtcccttccgtgtac

SEQ ID NO: 266326 - DNA, 492 bp, Homo sapiens
  misc_feature: GYAE6OF02ISCRK.45.84.H07.1.454.CMB.1.raw
  modified_base (270)..(270): a, c, t, g, unknown or other
  misc_feature (270)..(270): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagacgcgatcgacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaaccggggaancccctaaggtcctgatctacagggcgtctagtctagaaagtggggtgccaccaaggttcagcggcagtggatcgtgggacagaattcactctcaccatcagcagcctgcagcctgatgattttgctaacttcttctgccaagactgtagttttattggtacgttcggcctaagggacgaaggtgaatcaacgatgtggctgcacntctgtctcactctccnc

SEQ ID NO: 266327 - DNA, 507 bp, Homo sapiens
  misc_feature: GYAE6OF02G61C0.45.84.H07.1.454.CMB.1.raw
tcagacgcgatcgacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaagtgggtcccatcaaggttcagcggcagtggatctgggacagaattcactctcaccatcagcagcctgcagcctgatgtattttgactaactttattactgaccaatagtatgattagttattcgtacgttcggaccgtaagggacctaagggtagaaagtacaaacgtactgtacggactgcaccatcttgtcttacg

SEQ ID NO: 266328 - DNA, 507 bp, Homo sapiens
  misc_feature: GYAE6OF02GJCC2.45.84.H07.1.454.CMB.1.raw
  modified_base (497)..(497): a, c, t, g, unknown or other
  misc_feature (497)..(497): n is a, c, g, or t
tcagacgcgatcgacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaaccggggaaagcccctaaggtcctgatctacagggcgtctagtctagaaagtggggtgccaccaaggttcagcggcagtggatctgggacagaattcactctcaccatcagcagcctgcagcctgatgattttgctaacttacttctgccaagaacttgtagtttttattggtacgttcggccgaagggacgaaagggtggaaatcgaaacgtactggtggctgcacatctgtcttncttctccgtc

SEQ ID NO: 266329 - DNA, 510 bp, Homo sapiens
  misc_feature: GYAE6OF02F7E9Y.45.84.H07.1.454.CMB.1.raw
tcagacgcgatcgacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaacccggggaagccccctaaggtcctgatctacagggcgtctagtctagaaagtggggtgccacaaggttcagcggcagtggatcgtgggacagaattcactctcacatcagcagcctgcagcctgatgattttgctaacttcttctgaccaagtaacttgtagtttttatgggtacgttcggaccgaagggacgaaggtggaaatcgaaacgactgtggctgccacatctgtcttcattcctcccgtacc

SEQ ID NO: 266330 - DNA, 870 bp, Homo sapiens
  misc_feature: GYAE6OF02H5XV8.45.84.H07.1.454.CMB.1.raw
tcagacgcgatcgacacgaccggtgctcgatttagcagacgtctgtcgcgggggagtcagacccagtcaggacacagcatggacatgagggtccccgctcagctcctgggctcctgctgctctggctcccaggtgccaaatgtgacatccagatcgacccaatcttcctctaccctgtctgcatctgtaggagtacagagtcaccatactacgttggccggggaccaagtaacctaaagttagttaagtcgtaacgttgggttcggccgttaggtaacttcgaagaccggaaacgggaaaaacccgggggtaaaaccgtaccccccgttaaaaggtccgttcggtaaacctttcgtaacccggaaggggtccgttaaccgtaacggttaccgtaaaaggttaaaacggggttcgggggtaaccaccccgtaaacaaacgggggttttacgaacggacggggaccgtaaagggtacggtacgttaccggtaggggaaactaaccggtaaatttacccgtaaacctccgttaaccgaaccctttaagttacccgacgaaccggtaacgtcccggttaccggcctaacggtacccgtaggtaagttacggtttaattttaccggtaacttaaaacccgtttatttaccgttaccgtaaccgtaaaacgttaaccgtttaagggttaaccggttttttttaaacgtacgggtttaccggtaaccggttaaccgggaaaacgggtaacggggtaaaacgttaaagggtaaacgtaaaaccgtacgtaaaccggttggtacgggacgttacgaaccgtaacccttaggtaccgtttacttacgtttacgtaaccctttaccgttacccgtaacccg

SEQ ID NO: 266331 - DNA, 653 bp, Homo sapiens
  misc_feature: GYAE6OF02GLO18.45.84.H07.1.454.CMB.1.raw
tcagacgcgatcgacacgaccggtgctcgatttagcagacgtctgtcgcgggggagtcagacccagtcaggacacagcatggacatgagggtccccgctcagctcctggggctcctgctgctctggctcccaggtgccaaatgtgacatccagatgacccatctccttctaccctgtctgcatctgtaggagacagagtcaccatcacttcgccgggcagtacaaagtatagtgacgtggttggcctggtatcagacaacggaaacccgggggaaacgcccccgtaagggttccctagacttacgtacggaggggtccgttctaggtacgttaaagggaaaggtggggtacgaccgaaccgtaaggttcaggccggcagggtggatcgtagggacaagtaattcacttctaccaccatacacgcagcccgtgcctaggcctaggattgtacttttcgaccttaactttcttcgtagacctaaacgtagttacgtttaagtttttacgttacgggtacggtttaccggtacggtaaacggggtacggtaaaggtaacggtaaactaccggaaacgtacgttagggtacgtaccgttacgaccgtaaccgtattaccggttcttaccgttacccgtactttcccgtccctacccg

SEQ ID NO: 266332 - DNA, 450 bp, Homo sapiens
  misc_feature: GYAE6OF02GWW2F.35.68.G02.1.454.CMB.1.raw
  modified_base (431)..(450): a, c, t, g, unknown or other
  misc_feature (431)..(450): n is a, c, g, or t
tcagtacagatcgtcacgaccggtgctcgatttagtcgatagtgaagggaaaggggcgtggagtgggtctcaactattgatggtagtgctcactaacacatggtacgcagactccgtgaagggccggttcaccatctccagagacaattccaggaacacgctatatctgcaaatgaacagcctgagagccgaggacacgggccttatattactgtgcgaaagttcgtatagtggctggtacgaggtcgggatatgactactggggccagggagccctggtcaccggcctccgtcagccgtccaccaaggggcccatcggtcttccccctggcaccctcctccaagcgcacctctgggggcacgagcggcctgggctgccgtgtcaaggctacttccacgatctgtactgagcgggctggcaggcgcatagnnnnnnnnnnnnnnnnnnnn

SEQ ID NO: 266333 - DNA, 535 bp, Homo sapiens
  misc_feature: GYAE6OF02G3ZAE.35.68.G02.1.454.CMB.1.raw
  modified_base (287)..(287): a, c, t, g, unknown or other
  misc_feature (287)..(287): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (497)..(497): a, c, t, g, unknown or other
  misc_feature (497)..(497): n is a, c, g, or t
  modified_base (501)..(507): a, c, t, g, unknown or other
  misc_feature (501)..(507): n is a, c, g, or t
  modified_base (509)..(535): a, c, t, g, unknown or other
  misc_feature (509)..(535): n is a, c, g, or t
tcagtacagatcgtcacgaccggtgctcgatttagtcgatagtgaagggaaagggggtcgtcggagtcgggtctcaacctattgattggtagtgctcataacacatggtacgcagactccgtgaagggccgttcaccatctccagagacaattccaggtaacacgctatattactgcaaatgaacagcctgagagccgaggacgacggcctttatattactgttggacgaaagttcgtaatagtggctggtacgaggtcgggatagtgactactggggccagggacncccgtggtcaccgcctcctcagccctccgaccgaagggccccagtccggtccttcccccgnggccaccctcctaccaagngccaccctcgtcgggggccacgaggccggccccgtgggcgtcgcctcgggtaccaacggtacctacgttcccgacgtactacctagtaactcgacggcgggccttgggccaaagggccgacgattaacgntcgnnnnnnngnnnnnnnnnnnnnnnnnnnnnnnnnnn

SEQ ID NO: 266334 - DNA, 700 bp, Homo sapiens
  misc_feature: GYAE6OF02H6NJT.35.68.G02.1.454.CMB.1.raw
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
  modified_base (654)..(655): a, c, t, g, unknown or other
  misc_feature (654)..(655): n is a, c, g, or t
  modified_base (657)..(657): a, c, t, g, unknown or other
  misc_feature (657)..(657): n is a, c, g, or t
  modified_base (665)..(665): a, c, t, g, unknown or other
  misc_feature (665)..(665): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
  modified_base (695)..(695): a, c, t, g, unknown or other
  misc_feature (695)..(695): n is a, c, g, or t
  modified_base (697)..(699): a, c, t, g, unknown or other
  misc_feature (697)..(699): n is a, c, g, or t
tcagtacagatcgtcacgaccggtgctcgatttagtcgatagtgaagggaaaggggctggagtgggtctcaactattgatggtagtgctcataacacatggtacgcagactccgtgaagggccggttcaccatctccagagacaattccaggaacacgctatatctgcaatgaacagcctgagagccgaggacacggccttatctactgtgacgaaagttcgtataggtggctggtacggaggtcgggatatgactagtcgggccgagggacgccgtcggtccgaccgtcctaccgtcacgtccctaccgaacccgtaacgggaccccacggttacccggtccgtttaccccccgtcggtacccgaacccccgttcccgttacccgaaaacggaccgggtaccctaaccccgttccgggttcggggggaacccacccgtaaaccggccccgggcccggtttacccgggggcccgttacggcccgggtttccggtaaccgttaaaccggggtaaacccgtttacccgttaacccgtaaccggtaacgttaccgttccgggtttaacgtaccgggtacgggacccggggtcgtttaacgggccggtaaacgggccgtaccgtaggttaacgcgtggacngtncgngngngcgacgnngngcgcgcgngtcgcgcgcgtcgcnncncncncncgntcncnnnc

SEQ ID NO: 266335 - DNA, 516 bp, Homo sapiens
  misc_feature: GYAE6OF01ENZ9Y.21.34.D01.1.454.CMB.1.raw
  modified_base (374)..(374): a, c, t, g, unknown or other
  misc_feature (374)..(374): n is a, c, g, or t
  modified_base (510)..(510): a, c, t, g, unknown or other
  misc_feature (510)..(510): n is a, c, g, or t
tcagtcgtcgctcgcacgaccggtgctcgatttagatcgtctgtgttgggtttggggaggtctcagagaggagccttagccctggactccaaggcctttccacttggtgatctagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccaggctccagggaaggggctgggagtgggtggccaacataaaggaagatggaagtgacaaaaagtntgtggactctgtgaagggccgattcgaccatcttcagagacaacgccaagaactcactttatctgcaatgaatagcctgagagtcgaagacacggctgtgtattactgtgcgagagatgcgaggaggtggagcagntggtcg

SEQ ID NO: 266336 - DNA, 523 bp, Homo sapiens
  misc_feature: GYAE6OF01CSRAY.21.34.D01.1.454.CMB.1.raw
  modified_base (261)..(261): a, c, t, g, unknown or other
  misc_feature (261)..(261): n is a, c, g, or t
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (513)..(513): a, c, t, g, unknown or other
  misc_feature (513)..(513): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcgtggtttcgtgtagtattagaagtgtcagtgtgaggtgcagctggtggagtctgggggaggcttggtccagccgtggggggtccctgagagtctcctgtgtggcctntggattcaagtttaatacctattggatgagctgggtccgccaggctccgagggaagggctggagtgggtggaccaanagtaaaggaagatggaagtagagaaaaagtntagtggactctgtagaacgggcctattcaccatcttcagagacaacgccaagaactcacttatctgacaatgatagctagagagtacgagacgacgacgtgtagtattactgtgcgagagagtagagaggaggtaggagagagngtcgttacgg

SEQ ID NO: 266337 - DNA, 606 bp, Homo sapiens
  misc_feature: GYAE6OF01DQM0S.21.34.D01.1.454.CMB.1.raw
  modified_base (544)..(544): a, c, t, g, unknown or other
  misc_feature (544)..(544): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcgtggttttccttgttgttatttagaaggtgtccagtgtgaggtgcagctggtggagtcgtgggggaggcttggtccaggccgtggggggtccctgagactctcctgtgcagcctctgcattcaccttcagtcgaccacaacatggacgtgggtcccgccaggcctccgaggggaagggctggagtgggtcggccgtattacgaaggaagctaaacagttacagtacaagaactacggcgcgtctgtaggaaaggtagttccacatctacaaagagatgaattacaaagactacactgtactctagactaaagtgaaactacggacctaacgaaaaccggtaggaccaacccgggtaccgttagtaactttaagttggttaacggggtaanaaaccggaaaaggtacgttaggaagtttgggttagggtagggttaacgcgttgggttaaacg

SEQ ID NO: 266338 - DNA, 560 bp, Homo sapiens
  misc_feature: GYAE6OF01CJN5N.21.34.D01.1.454.CMB.1.raw
  modified_base (457)..(457): a, c, t, g, unknown or other
  misc_feature (457)..(457): n is a, c, g, or t
  modified_base (545)..(545): a, c, t, g, unknown or other
  misc_feature (545)..(545): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagccgtggggggtccctgagagtctcctgtgtggcctctggattcaagtttaatacctattggatgagctgggtccgcaggctccagggaaggggctggagtgggtggaccaacagtaaaaggaagagtaggaaagtagaaacgaaaaaagtataggtaggactcgtagtggaaagggccgattcaccatcttacagagaacaacgaccaaagaacctcaactttanctagacaaatgaaatagcctgaagagtacgaaagacacggctagtagtattactgtgacgtagagagtaggcggaaggagggtggaancgagcgtcgttacgg

SEQ ID NO: 266339 - DNA, 568 bp, Homo sapiens
  misc_feature: GYAE6OF01EM123.21.34.D01.1.454.CMB.1.raw
  modified_base (308)..(308): a, c, t, g, unknown or other
  misc_feature (308)..(308): n is a, c, g, or t
  modified_base (385)..(385): a, c, t, g, unknown or other
  misc_feature (385)..(385): n is a, c, g, or t
  modified_base (554)..(554): a, c, t, g, unknown or other
  misc_feature (554)..(554): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtgggggtccctgagagtctcctgtgtggcctctggattcaagtttaatacctattggatgagcttgggtccnccgaggctccgagggaaggggctgggagtgggtgaccaaacgagtaaaggaagagtaggaagtagaaacaaaaagtntaggtaggactcgtagtaggaagggccgtaattcacctatcttacagacgaacaacgaccaagaactcaactttatctagacaaatgaatagcctagagagtacgaagacgtacggctaggtagttattacgtggtgacgagagagtaggacggagggaggtggagacnggtcgtcggttacg

SEQ ID NO: 266340 - DNA, 525 bp, Homo sapiens
  misc_feature: GYAE6OF01CTS0X.21.34.D01.1.454.CMB.1.raw
  modified_base (262)..(262): a, c, t, g, unknown or other
  misc_feature (262)..(262): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcgtggtttcgtgtaggtctttagaagtgtcagtgtgaggtgcagctggtggagtctgggggaggcttggtccagcctggggggtccctgagagtctcctgtgtggcctntggattcaagtttaatacctattggatgagcgtgggtccgccaggctccgagggagggctggagtgggtggccaagagtaaaaggagatggaagtgaanaaaaagtntggtaggactntgtgaagggccaatcaccatcttcagagacaacgccaaagaactcacttanctgacaatgaatagcctagagagtacgaagacacggcttgtagttaatactgtcgngagagngtagcgaggnggtaggancgagcgtcggtacg

SEQ ID NO: 266341 - DNA, 525 bp, Homo sapiens
  misc_feature: GYAE6OF01D7L0V.21.34.D01.1.454.CMB.1.raw
  modified_base (377)..(377): a, c, t, g, unknown or other
  misc_feature (377)..(377): n is a, c, g, or t
  modified_base (515)..(515): a, c, t, g, unknown or other
  misc_feature (515)..(515): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagcctggggggtccctgagagtctcctgtgtggcctctggattcaagtttaatacctattggatgagctgggtccgccaggctccgagggaaggggctgggagtgggtggccaacagtaaaggaagatggaagtgaacaaaaagtntgtggactctgtgaaggccgattcacatcttcagagacaacgccaagaactcactttatctagacaaatgaatagcctagagagtcgaagacacggctgtagtattactgtgcgaagagatagacgaggaggtggagnagcgtgtacg

SEQ ID NO: 266342 - DNA, 520 bp, Homo sapiens
  misc_feature: GYAE6OF01C324C.21.34.D01.1.454.CMB.1.raw
  modified_base (483)..(483): a, c, t, g, unknown or other
  misc_feature (483)..(483): n is a, c, g, or t
  modified_base (502)..(502): a, c, t, g, unknown or other
  misc_feature (502)..(502): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccaggctccagggaagggctggagtgggtggccaacataaaggagatggaaagtgaacaaaaagtatagtgggactctgtgaagggccgattcaccatcttcagagacaacgccaagaactcactttatctgacaaatgaatagcctagagagtcgaagacacggctgtgtattacngtgcgagagatagcgaggnggtggagcagcgtgtacg

SEQ ID NO: 266343 - DNA, 521 bp, Homo sapiens
  misc_feature: GYAE6OF01C3BHJ.21.34.D01.1.454.CMB.1.raw
  modified_base (375)..(375): a, c, t, g, unknown or other
  misc_feature (375)..(375): n is a, c, g, or t
  modified_base (479)..(479): a, c, t, g, unknown or other
  misc_feature (479)..(479): n is a, c, g, or t
  modified_base (509)..(509): a, c, t, g, unknown or other
  misc_feature (509)..(509): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagcctggggggtccctgagagtctcctgtgtggcctctggattcaagtttaatacctattggatgagctgggtccgccaggctccgagggaagggctggagtgggtgccaacagtaaaggaagatggaagtagaacaaaaagtntagtggactctgtagaagggccatcacatctcagagacaacgcaagaactcacttatctagacaatgaatagctagagagtcgaagacacggctgtgtattacngtgcgagagagtagacgagggaggtggagnagcgtcggtacg

SEQ ID NO: 266344 - DNA, 698 bp, Homo sapiens
  misc_feature: GYAE6OF01BXP05.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtccctgagagtctcctgtgtggcctctggattctaagtttaatacctattggatgagctggtccgcaggctccgagggagggctggagtgggtggccaacgaagtaaaggaagagtaggaagtagaaacaaaaagtagtggtaggactcgtaggtaggaaacggggccgtaagttccgaacctagttaccgtttacgaacggaacgaaacgaaacccggaacccaaaacgtaaaccgttactaacctttttaacgtaccttacggaacctaaaagttaacggtaaattaacggtacccgttaaggaacgggtaaggttaaccgggaaacgtaacccggaacgggtccttaggttacggttaatttaaccgtggttaggaccggtaaggtacgaaggttaggaccgggaagggacggggttagggacggacgtaaggtccgttacggtttaacggg

SEQ ID NO: 266345 - DNA, 605 bp, Homo sapiens
  misc_feature: GYAE6OF01CMJ8V.21.34.D01.1.454.CMB.1.raw
  modified_base (354)..(354): a, c, t, g, unknown or other
  misc_feature (354)..(354): n is a, c, g, or t
  modified_base (471)..(471): a, c, t, g, unknown or other
  misc_feature (471)..(471): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcgtggggggagcgttggtccagccgtggggggtccctgagagtctccgtgtgtggcctctggattcaagtttaatacctattggatgagcgtgggtccgcgaggctccgaggggaggggctgggaggtgggtcggaccaanaagtaaaggaagagtaggaagtagaaacaaaaaggtagtaggtggactcgtggtaggaacgggtccgtattacgacctatcttacaggacaacgaaccgacaagaactctactttanctacgataaatgaatacgtctagaacgtagtacgaagacgacgtgtcgttagtacttcgtggtagacgtaaggacggtaagtcgggacgggtaagggtaggggtacggacggcacgggtcgttccgggttaacg

SEQ ID NO: 266346 - DNA, 743 bp, Homo sapiens
  misc_feature: GYAE6OF01C35WP.21.34.D01.1.454.CMB.1.raw
tcagtcgtcgctcgcacgaccggtgctcgatttagatcgtctgtgttgggtttgggggaggtctcagagaggagccttagccctggactccaaggcctttccacttggtgatcagccactgagcacagaggactcaccatggaactggggctgagcgtggtttccgtgtagtatttacgaagtgtcagtgtgaggtgcagctggtggacgtcgtgggggagctttgggtccaggtccgtgggggtccctgagtgtctccgtgtgtggcctctaggattcgaagtttaatacctattggatgagcgtggtccgccaggctaccgagggaacgggctgggacgtggtggaccaagattaaaaggagagtaggaagtagaaacgaaaaagttgtaaggtacggaactccgtagtaggaacgggtacgtacgttaccgaacctagttaacccgttaccgaaacggtaaggaaccccgaaaacgggtaccccaaaaaggttaaaaccttccttaaaccggtttttaaattccgttaaggaaccttaaaagtttacgaaaacggtttagacccggttaaaggaagtaccggtttaaccgggaaaagttaccggaaccgggttcgtaaggttaccgtaagtttaaccggtggttacgacgggtaaacgtaaggtaacgtaagggaaccggtaaggggaaccgggttggggaaaaccgccgtaaaacggtccgttccggttttaaaccggg

SEQ ID NO: 266347 - DNA, 542 bp, Homo sapiens
  misc_feature: GYAE6OF01DKK6K.21.34.D01.1.454.CMB.1.raw
  modified_base (529)..(529): a, c, t, g, unknown or other
  misc_feature (529)..(529): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccaggctccgagggaagggctggagtgggtggccaaacataaaaggaagagtggaagtgaacaaaaagtatagtggactctgtagaagggccgaagttcaccatcttcagtagaacaacgaccaagaactcaactttatctgacaaatagaatagcctagagacgtacgaaagacacggctgtgtattactgtgcggagagataggacgagggaggtggagnagtcgtcggtacg

SEQ ID NO: 266348 - DNA, 682 bp, Homo sapiens
  misc_feature: GYAE6OF01DCBGD.21.34.D01.1.454.CMB.1.raw
  modified_base (383)..(383): a, c, t, g, unknown or other
  misc_feature (383)..(383): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaagttgtccagtgtgaggtgcagctggtggagtcgtgggggaggcttggtccagccgtgggggtccctgagagtctcctgtgtggcctgtggattctaagtttaatacctagttggatgagcgtgggtccgcaggctccgaggggagggctggagtgggtggaccaacaagtaaaggaagagtaggaagtagaaacaaaaagtntaggtggaactcgtagtaggaaacgggtccgtaagttccaaccgtattccttacaaggtacgaacgaaacccgaccaaaacgtaacctactaaccttttatacctaggaaccaaagtcgaaattacgaccgttaggaacgtaacggtaccggaaaggtaccgaacgggtacttaggttacggttaacttacggttaggttagaccgggtaaaggtaaggaggttaacgggccggggaaagggggtacgggttacggggaaacggtccggaacgggttcccggttaccgggtttaaccgg

SEQ ID NO: 266349 - DNA, 609 bp, Homo sapiens
  misc_feature: GYAE6OF01A91NN.21.34.D01.1.454.CMB.1.raw
tcagtcgtcgctcgcacgaccggtgctcgatttagatcgtctgtgttggggtttggggaggtctcagagaggagccttagccctggactccaaggcctttccaacttggtgattcagcactgagcacagaggactcaccatggacgtgggctgtagcgttgggtttccttagttgttattttagaaggtgtccagtgtgaggtgcgagtctggtgagtcgtggggacggcttggtccaggtccgtcgggggtccctggagtgtctccgtggtgtcggcctcgtggtattacgaagtttaactaccttattggattgagtcgtgggtcccgccgaggcctaccggaggggtaacgggctgggagtggggtgaccgaacgaagtaaaaggagagtaggaagtgaaacgaaaaagtgtggtagactgtgtaggacggcctattcactatctacagagaacaaccgtacaaagactactaactttatacctagtacaaactgaactcgacgtagacgtagtacgaagacgaacgtcgtaggtagttagtacgtggtacggacggagtagaagttcggaggagggtaggtggacgtagaccggtcgtggttacg

SEQ ID NO: 266350 - DNA, 564 bp, Homo sapiens
  misc_feature: GYAE6OF01BS1D4.21.34.D01.1.454.CMB.1.raw
  modified_base (381)..(381): a, c, t, g, unknown or other
  misc_feature (381)..(381): n is a, c, g, or t
  modified_base (485)..(485): a, c, t, g, unknown or other
  misc_feature (485)..(485): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtccctgagagtctcctgtgtggcctctggattcaagtttaatacctattggatgagctggggtcccgccgaggcctccgaggggaagggctgggagtgggtggacaacaagtaaaggagatggaatgaacaaaaagtntaggtggactctggtgaagggccattcactatcttacaggacacaacgaccaagaacctcactttatctgacaaatgaatcgctagagagtacgaagacgacgngttagtagttaattcgtggtcgaggaagaaggagtaggacggaaggggagggtacgggaagcacggtcgtcggttacgg

SEQ ID NO: 266351 - DNA, 519 bp, Homo sapiens
  misc_feature: GYAE6OF01B2VU4.21.34.D01.1.454.CMB.1.raw
  modified_base (470)..(470): a, c, t, g, unknown or other
  misc_feature (470)..(470): n is a, c, g, or t
  modified_base (507)..(507): a, c, t, g, unknown or other
  misc_feature (507)..(507): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggagcttggtccagccgtggggggtccctgagagtctcctgtgtggcctctggattcaagtttaatacctattggatgagctgggtccgccaggctccgaggggaggggctggagtgggtggccaacataaaggagatggaagtgaacaaaagtatgtggactctgtagaagggccgattcaccatcttcagagacaacgccaagaactcactttatctgacaatgaatagcctgagagtacgaagacacggntgtgtattactgtgcgagagatgcgaggaggtggagnagcgtcggtacg

SEQ ID NO: 266352 - DNA, 696 bp, Homo sapiens
  misc_feature: GYAE6OF01AF2KX.21.34.D01.1.454.CMB.1.raw
tcagtcgtcgctcgcacgaccggtgctcgatttagatcgtctgtgttgggtttgggaaggtctcagagaggagcccttagcccctggacctccaaggccctttccacttggtgatcagcactgagcacagaggactcaccatggaactggggctgagctgggttttccttgttgttattttagaatgtgtccagtgtgaggtgcagctggtggagtcggtgggggaggtcgttggtccgaggcccgtggggggtccctggagagtctcctgtgtggcctctggattcaagtttaatacctattggatgagcgtgggtccgccaggctccgaggggaaggggctgggaggtgggtcggaccaaacgaagtaaaagggaagtagttagggaaagtggaaacaaaaaaggtgtggtaggaactcgtggtaggaaacgggtccgtatttaccacctatcttacgaagtacgaaccaacgaccaaagtaacctactaactttatccgtagaactaaagtagaacgtacgtaccgtaggaacgtacggtacgaaacggtaccgacggtccgttaggttagttaacgttaccgtaggttcggtaccggaaggtaacggtaaggttaacggggaaccggggaaacgggggttaagggggacgggtaacggtaccggtaacgggttccccggttttaacccgggg

SEQ ID NO: 266353 - DNA, 580 bp, Homo sapiens
  misc_feature: GYAE6OF01BQ7OO.21.34.D01.1.454.CMB.1.raw
  modified_base (337)..(337): a, c, t, g, unknown or other
  misc_feature (337)..(337): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaagttgtccagtgtgaggtgcagctggtggagtcgtgggggagcttgggtccaggcccgtggggggtccctggagagtctcctgtgtggcctctggattcaagtttaatacctattggatgagctgggtccgccaggctccgaggggaggggctgggngtgggtggaccaacgaagtaaaggagagtaggaagtagaacaaaagtgtgtggactcgtagtgaagggccattcaccatcttgagagacaacgaccaagaacctctactttatctagacaaatgaatacggcctggaagtacgtacgaagaccgacgggtcctaggttagttactttacgtgtaggaccggagagtaagtagggcggaagggtagggtagggagacgaggtccgtcggttacg

SEQ ID NO: 266354 - DNA, 770 bp, Homo sapiens
  misc_feature: GYAE6OF01CLFI9.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcgttgggttttccttgttgttattttagaaggtgtccagtgtgaggtgcagcgtggtggagtcgtgggggaggtcgttgggtccaggtccggtggggggtcccctggagtagtccttcctggttggtcggcccttcgtggtattacgtaaagttttaaactaccttagttggaattggtacggtcgttcggggtcccgccgacggtccgtaccggaaggggtaacggggcgtagggacgggtggggtacggaccaaacgaagttaaaaagggaagtaagtaaggaaagtaagaaacgtaaaaagtagtaggtaggtaactcgtaggtaggaacgggtccgtaacgttaccaaccgtacgttaccgttacgaagtaacgaaaccgtaaacccgaaccgaaagtaaaccttacctaaacttttacgttacctagtaaacctaaaagttacgtaaagtaaccgtaccgttaaggaacggttaacgtaaccggaaacggaccgtaacggttacgtaggttacgttaaacttacggtggttaacgacgggtaaacgtaaggagttaaggggacgggtaaagggtaggggtacgaacggtacgacggtcgttacggtttacgg

SEQ ID NO: 266355 - DNA, 552 bp, Homo sapiens
  misc_feature: GYAE6OF01DXO22.21.34.D01.1.454.CMB.1.raw
  modified_base (388)..(388): a, c, t, g, unknown or other
  misc_feature (388)..(388): n is a, c, g, or t
  modified_base (536)..(536): a, c, t, g, unknown or other
  misc_feature (536)..(536): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtcagtgtgaggtgcagctggtggagtcgtggggggaggcttggtccaggtccgtggggggtccctggagagtctcctgtgtcggcctctggattcaagtttaatacctattggatgagcgtgggtccgccaggctccgagggagggctggagtgggtgcaacagtaaagagatggaagtagaacaaaagtatgtaggactgngtgaaggccgattcaccatcttcagagaacaacgccaaagaactctactttactctagacaagtagaatagctagagagtacgaagacgacggactgtagttacttacgtgtaggcgaaggagagtaggacggagggagggtaggagngaaggtcgtcggtacg

SEQ ID NO: 266356 - DNA, 791 bp, Homo sapiens
  misc_feature: GYAE6OF01E5WZ6.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagtcttgggttttccttgttgttattttagaaggtgtccagtgtgaggtgcagctgggtggagtcgtgggggagcttggtccaggcccggtcgggggtcctagagtcgtctccgtgtggtcgtcctgtaggtattacgtaagtttaactaccttagttggtatggacggtcgttcggggtccccgccgtaggtccgtaaccgggaagggggtaacggggtcgtaggggtacgggttcggggtaccggaacccaaaacgtaaaggtaaaaacgggaaggtaaggtaagggtaaagtaaacgaaaacggtaaaaaggttggttagggtaacggtaccgttacggttagggtaacgggtaaaccgggtcccgttaaacgttacccctaacgttacgtaccgtttaaacgaacggtaaaccgaacccgtaaacccggaaccgtaaaccgttaacccgttaaccttaacttttacgtaacctacgtaaactaaacgtacgaacgtacgtacgttaaggaaccgtaacggtaaccgtaaacgaccggtacggtcgttaggttaagttacttacggtgtagacgggtagtaaggagtacgggacggaagggtacgggtaggacgtagtacggtcgttaccggttacgg

SEQ ID NO: 266357 - DNA, 733 bp, Homo sapiens
  misc_feature: GYAE6OF01DCGI8.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttatttagaaggtgtccagtgtgaggtgcagctggtggagtcgtgggggagcttggtccaggccgtgggggtccctgagagtctccgtgtgtggcctcgtggattctaagtttaatacctattggatgagcgtgggtccgccgaggctccggaggggaaggggcgtgggaggtgggtcggaccgaacgaagtaaaggaagagtaggaaagtagaaacgaaaagtagtaggtacggtactcgtggtaggacggtaccgtattaccacctatccttacgaagtacgaaccgaacgaccgaaagtaaccttcttaaccgtttataccgtagaactaaagtacgtaaattacgtaccgtagaacgggtaacggtaaccggaaacggtaccggtaaccgggtacgttacgggtttagttaaccgtttaacggttcggtaacggtaccgggtaaacgggtaaaggttaacgggtaccgggtaaaccgggggtaagggggttaaacggggttcggggtaaaccggtaccggtaacccgggtacccggttttcccgggtttaaaaccgggg

SEQ ID NO: 266358 - DNA, 688 bp, Homo sapiens
  misc_feature: GYAE6OF01BDD44.21.34.D01.1.454.CMB.1.raw
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
  modified_base (388)..(388): a, c, t, g, unknown or other
  misc_feature (388)..(388): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagcttgggttttccttgttgttatttagaggtgtccagtgtgaggtgcagctggtggagtcgtgggggagtcttggtccaggccgtgggggtcctgagngtctcctgtgtgcctcgtggattcaagtttaatacctattggatgagcgtgggtccncgaggcctccggaggggagggctgggaggtgggtcgaccaaacgaagtaaaggaagagtaggaagtacgaaacaaaaaggtntaggtggacttcgtaggtacggaacgggtcctaattcaacctattccgtttacgaaggaactaaccgaaccgaaccgaaagtaaaccgttacctaacttttactacgtacgtaacgtaaatagtaacgtaagacccgtaggaacgtaacggtaccggaaagaccgtaacggtacgttagttaggttaacttaccgttagggtacggacgggtaaagtaaggtaacgggttaaggaccgggtaaaggggtaacgggtacggggaaacgccggaaacggtcccggttcgggtttaaaccggg

SEQ ID NO: 266359 - DNA, 644 bp, Homo sapiens
  misc_feature: GYAE6OF01D0XOL.21.34.D01.1.454.CMB.1.raw
  modified_base (545)..(545): a, c, t, g, unknown or other
  misc_feature (545)..(545): n is a, c, g, or t
  modified_base (558)..(558): a, c, t, g, unknown or other
  misc_feature (558)..(558): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggggctgagctggggttttccttgttgttattttagaaggtgtccagtgtgaggtgcagctggtggagtcgtgggggagcttggtccaggccgtggggggtccctgagacgtctcctgtgtggcctctggattcaagtttaatacctattggatgagtcgtgggtccgccaggctccgagggaagggctgggagtgggtggaccaacaagtaaaggaagagtggaaagtagaaacaaaaagtgtacgtaggtactctggtaggaacgggccgtaattaccgacctatacttccgaagacgaaacgaaacccgaccaaagaaacttacctactttatactagactaaatacgaagtacgcgtaaggtaagaggttaacggaagtaacgacggtcgtaggtnttaagtttaacgnggtacgcgggtaaagtaaggtacgtaaaggaccgggtaaggggtaaggggtacgggaaacggtcaacgggtcgtccggttaaccgg

SEQ ID NO: 266360 - DNA, 599 bp, Homo sapiens
  misc_feature: GYAE6OF01D2BNL.21.34.D01.1.454.CMB.1.raw
  modified_base (415)..(415): a, c, t, g, unknown or other
  misc_feature (415)..(415): n is a, c, g, or t
  modified_base (581)..(581): a, c, t, g, unknown or other
  misc_feature (581)..(581): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggtttttccttgttgttattttagaaggtgtccagtgtgaggtgcagctgggtgggaggtcgtggggggaggtcgttgggtcccgaggtcccgtcgggggggtcccctggaggtagttctccgtgtggtcggccttcgtggtatttctaaagtttaatacctattggatgagcgtgggtccgccaggctccgaggggaaggggctgggaggtgggtcgaccaacaagtaaaggaagagtaggaagtagaacaaaaagtntagtggatcgtgtagaacggcctatacacatctacagagacaacgaccaacgaactacgtactttactctagactaatagaatacgacgtagagagtacgaagaccgagtactgtagtattacgtggtagacgaggtaagagtaggacggagggaggtagggacgngacggtcgtcggttacgg

SEQ ID NO: 266361 - DNA, 615 bp, Homo sapiens
  misc_feature: GYAE6OF01ETASQ.21.34.D01.1.454.CMB.1.raw
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
  modified_base (361)..(361): a, c, t, g, unknown or other
  misc_feature (361)..(361): n is a, c, g, or t
  modified_base (385)..(385): a, c, t, g, unknown or other
  misc_feature (385)..(385): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaacgtggggctgagcttgggttttccttgttgttattttagaaggtgtccagtgtgaggtgcagcgtggtggagtcgtgggggagcttggtccagccgtggggggtccctggagtagtctcctgtgtggcctctggtattcaagtttaatacctattggatgagctgggtccncaggctccgagggaagggctgggagtgggtggccaanaagtaaagganagtaggaagtgaaactaaaaagtntagtaggtaacctgtaggtaggaaacgggccgtaatttacccgaacctaagttccctttaacgagaaacgaacccgaaacgacccgaaaacgtaacctacctaacttttactcgttagactaaagtataacgtagccgtaagaagaggtaacgaacgtacgacggctggtattagtagtgtgacgagagaagtggacggaagggacggtggaagcgagtcgtcggttacg

SEQ ID NO: 266362 - DNA, 811 bp, Homo sapiens
  misc_feature: GYAE6OF01EOVC5.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttccttgttgttattttagaaggtgtccagtgtgaggtgcagctggtggaggtcgtgggggaggtcttggtccagcccgttggggggtcccctggagagtcctccgtggtgtggcctcgtggtattactaaagtttaactacctagttggatgagtcgtcggggtcccgccgagggtccgtaccggaagggggtaacgggggccgtaggggtacgggttggggtcggaccccgtaaaacgtaaaggtaaaaagggaacgtaaggtaagggaaaaggttaacggaaaacgtaaaaaaggttgtaggtacggtaacgtcgtagggtagggaaacgggtaccgtaacttacctaacccgtagtttccgttacgaaggtacgaaaccgtaaacccgaaccctaaaaggtaacccttaccgtaaacctttttacgtaccgttagaacctaaaagttacgtaaacgttacgtacccgttaagggtaacgtaaccgggtaacggaaaacggtacccggtaacgggtacttacgggttaagttaaactttaaccggtgggttacggaaccgggtaaaggtaaggtaacggttaacgggacgggtaaggggaacggggttaggaacggtacgaacggttccgttacgggtttaaaccgg

SEQ ID NO: 266363 - DNA, 570 bp, Homo sapiens
  misc_feature: GYAE6OF01DHFPQ.21.34.D01.1.454.CMB.1.raw
  modified_base (469)..(469): a, c, t, g, unknown or other
  misc_feature (469)..(469): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcgttggtccagccgtgggggggtccctggagagtctcctgtgtggcctctggattcaagttttaatacctattggatgagctgggtccgccaggcctccgaggggaaggggctgggaggtgggtggaccaacagtaaaaggagaagtggaagtgaaacaaaaagtataggtaggactcgtggtaggaaaggggccgattaccaccattccttcaagacgaacaacgccaaagaactactactttanctagacaaatgaatagcctagagtagtacgaagacacggtctgtagtattacgtgtgcgaagagagtaaggcggaagggaggtggagcgagcgtggtacgg

SEQ ID NO: 266364 - DNA, 527 bp, Homo sapiens
  misc_feature: GYAE6OF01CJGDO.21.34.D01.1.454.CMB.1.raw
  modified_base (515)..(516): a, c, t, g, unknown or other
  misc_feature (515)..(516): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctggagagtctcctgtgtggcctctggattcaagtttaatacctattggatgagctgggtccgccaggcctccgagggaagggctgggagtgggtgccaacataaaggaagatggaagtagaacaaaaagtatggtaggactcgtgtagaagggccattcaccatcttcagagacaacgcaagaactcacttatctgacaaatgaatacgctagagagtacgaagacacggctagtagtattactgtgcgagagatagcgaggaggtggannagtcgtgtacg

SEQ ID NO: 266365 - DNA, 629 bp, Homo sapiens
  misc_feature: GYAE6OF01CQCRE.21.34.D01.1.454.CMB.1.raw
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtcagccgtgggggtccctggagagtctctggtgtggcctcgtggtattactaagtttaatacctattggatgagcgtcgggtccgccaggcctccgagggagggctgggaggtgggtggaccaacgagtaaaaggagtagtaggaagtagaaacaaaaagtgtagtcggactcgtaggaggaacggcctagttacaccgtaattcttcgaagtaacgactaacgaccaaagaactctaactttacactagactaaatgaaatacgccgtagaagtacgtacgaagacgacggtctaggtcgttaattacgtggtacggtacggaaacggtaaggaggttaacgggcggaaaggggggtacggtaggggaacaccggtaaggtcccggttcgggttaacgg

SEQ ID NO: 266366 - DNA, 866 bp, Homo sapiens
  misc_feature: GYAE6OF01BU8V2.21.34.D01.1.454.CMB.1.raw
tcagtcgtcgctcgcacgaccggtgctcgattttagatcgtctgtgttgggtttggggaggtctcagagaggagccttagccctggactccaaggcctttccacttggtgattcagcactgagcacagaggactcacatggacgtgggctgtagcgtggtttcttgttgttatttagagtgtcagtgtgaggtgcagtcgtggtggagtcgtggggtacggtcttggtccaggtccggtcggggggttccctggacggtacgtccgttccgtggttcggtcgggtccttacggtcggtatttacgtaaagttttaataccgttattgggattggagtcgtcgggtcccgccgagggacctaccggagggggtaagggggccgttaggggagggttggggtacgggaccccaaagtaaaggttaaaagggaagtaaggttaggaaacgttaggaaaacgtaaaaaaggttgttagggttacgggaactttacgtagggttagggaaacggggtccctaacgtttacccaacctacgttacttacgaaacgtacgaaccgtaaacccgaccgaaacgtaaactacccttaacttttacgttcgtaacgtaacgtaaaacgttaacggtaacgttaaccgtaccgtaagggtaaccggtaacggtaacccgggtaaaaggttacccggaacggggtttaccttaggggtttacgttaaaacgttttaccgggtacgggtttaacggaacgggtaagggtaacgggtaaaggggtttaacggacccgggggtaaaggggttaaccgggggttaggggaaccgggttaacccggttaacggggttcccggtttaccggggtttaaacccgg

SEQ ID NO: 266367 - DNA, 767 bp, Homo sapiens
  misc_feature: GYAE6OF01DTLE2.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttccttgttgttattttagaaggtgtccagtgtgaggtgcagcgtgggtggagtcgtgggggagtcgttggtccaggtccggtcgggggtccctggagacgtcctccgtggtgtcggcctcgtggtattactaagtttaactacctagttggatgagtcgtcgggtccgccgaggtcctaccggagggaagggtcgtgggaggttgggtacgaccaaagaagtaaaaggagtagtaggaagtagaaaacgtaaaagtgtaggtaggtaactgtaggtacgggaaacggtccggtaacttaccgaacctacgtttaccgttaacgaaacggaacgtaaacccgtaaaccgaccgtaaaacggttaaccctaccgtttaacctttttaacacgttaaacgtaaaccttaaaagttacgtaaaagttaccgtacccgttaaggaaacggtaacggtaaccgaaacggtaccgtacgggtactttaggttaacgtttaccgttaaacggtcggtaggtaaccggtaaaggtaagtaacggtaaacggggacgggtaaggggtacggggttacggaacgggacgtaacggttcccgttccgggttaaacgg

SEQ ID NO: 266368 - DNA, 758 bp, Homo sapiens
  misc_feature: GYAE6OF01C8GTN.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcggtgttcggtctaaggtcgttcgaagttaggcagtgtgaggtgcgagtcgtggtagcgtcgtggggagccttaggccaagccgttgggggtccctagaggcgtctcctgttgtggcccttcgtaaggccttacaaaggttttaacaccgttaattcggaattagacgtcgtacggggtcccaccgtaaggcgttacccggaagggaacggggtcggtacgggtacgggtacgggttggggtaccctaacgtaaaggtaaacggtaaacggtaacggtaggtaaacggtacgggtaaaaacgtaaacggtaagtacgtacggtacgtacgtacggtacggtaacggtacgtacgtaccgtaccgtacgtacgtacgtaacgaacgaacgtaacgaaccgtaacgtaacctaacttacgttaacgttacgtacgtaacgtaacgtacgtaacgtacgtacgtaagtacgtaacggtaacggtaacgtaacgtacgtacgttacgttacgttaacggttacggtacggtacggtaacgaacgtaggtaacggtacggtaacggtaaggtacggtacggtacggtacgtacggtccgttaccggtacg

SEQ ID NO: 266369 - DNA, 518 bp, Homo sapiens
  misc_feature: GYAE6OF01BD4Y6.21.34.D01.1.454.CMB.1.raw
  modified_base (371)..(371): a, c, t, g, unknown or other
  misc_feature (371)..(371): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggtttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccaggctccagggaagggctggagtgggtggccaacataaaggaagatggaagtgaacaaaaagtntgtggactcgtgtgaagggccgaattcaccatcttcagagacaacgccaagaactcactttanctgcaaatgaatagctganagtcgaagacaggctagtntatactgtgcgagagataggcgaggaggtcggagnagngtcgtacg

SEQ ID NO: 266370 - DNA, 646 bp, Homo sapiens
  misc_feature: GYAE6OF01E1FRJ.21.34.D01.1.454.CMB.1.raw
  modified_base (313)..(313): a, c, t, g, unknown or other
  misc_feature (313)..(313): n is a, c, g, or t
  modified_base (384)..(384): a, c, t, g, unknown or other
  misc_feature (384)..(384): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtcccctggagagtctccgtgtgtggcctctggattcaagtttaatacctattggatgagcgtcgggtccnccgaggctccgagggaagggcgtggagtgggtgccaagagtaaaggaagagtaggaagtgaacaaaaagtntaggtggactgtggtaggaacgggctagttcaaccgtattaccttacgaagtagaaccaaccgaccaaagaaccttacgtaactttaagtcttagaactaaactagtaaatacggacctaggaacggtagtaaccggaaagaccgacggtcctaggtacgttaacgttacgttgggtacgtacgggtaaggtaaggtataacggggaccgggaagggtacgggtagggtaacggaccggacggtccgttacggttaaccggg

SEQ ID NO: 266371 - DNA, 791 bp, Homo sapiens
  misc_feature: GYAE6OF01A23ZK.21.34.D01.1.454.CMB.1.raw
  modified_base (333)..(333): a, c, t, g, unknown or other
  misc_feature (333)..(333): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttccttgttgttatttagaaggtgtcagtgtgaggtgcagcgtggtggagtcgtgggggagtcgttggtccaggtccggtcggggggtccctggagtacgtcctcgtggtggtcggcctcgtggtattcgtaaagttttaactaccttagttggatggagtcgtcgggtccnccgtaggccgtaccggaaggggacgggtctagggaggtgggtacggaccaaacgaagtaaaacggagtagtacggaaagtacgaaaacgtaaaaagtgtaggtacgtactcgtaggtacggaacggggtcctaagttccaacctagttaccgttagaacggtaacgaaccgtaaaccggaacccgaaacggttaacccttacgttaaccttttacgaccgtaaggtaaacctaaagttacggtaaacttaccggtaccgtaaggtaaggtaccggtaacgggaaaacggaccggttaaccggggtctttacggtttaacggttaacgtttacgggttacggtacgggtaaaccgggtaaaggtaaccgtaaggggttaaaccgggacgggtaaaggggggtaacggggttaacggaaacgttccgggaacggtttacccggttaccggggttaaacgg

SEQ ID NO: 266372 - DNA, 708 bp, Homo sapiens
  misc_feature: GYAE6OF01C49X3.21.34.D01.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaacgtgggctgagcttgggttttccttgttgttattttagaaggtgtccagtgtgaggtgcagcgtggtggagtcgtgggggaggcttgggtccaggtccggtggggggtccctggagacgtctccgtgttggtggccctcgtggattacgtaaagttttaactaccttagttggatggagtcgtcgggtcccgcgaggcctccggaggggaagggcgtggaggtgggtcgaccaaanaagtaaaaggagagtaggaagtagaaacgaaaaagttgtaggtacggtactacgtaggtacggaacggggtccgtaattacccgaactagttacccgttagaacggtaacgaacccaaacggaacccaaaacggtaacctacttaaccgttttattaccctaggtaactaaacgttagtaaacgtacgtaccgtaagtaacggtagtaaacgaaacgtaacgacggtactaggttacgttagttacgtaggttagaacgtaaggagtaaggttacgggaacgggtaggggtaagggtagggaacggtacgaggtccgttacggttaacgg

SEQ ID NO: 266373 - DNA, 810 bp, Homo sapiens
  misc_feature: GYAE6OF01AC5LO.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcgtgggggagcttggtccagccggtcggggggtccctggagacgtctccgtggtggtcggccttcgtggtacttcgtaaaggttttaaactacccttagttacggaattggaacggtcgttcgggggtccccgccgaagggtccctcccggaaggggggtaacggggtctaggggaggttcggggtcggacccaaacgtaacgtaaaagggaacgtagtacgggaaggttacgaaacgtaaaaaggtgtaggtacggtaacttcggtaggtacggaaacggggtccgtaattcccgaacctagttccttacgaagtacgaaccgaaccgaaccgaaacgaaccgttcttaaccttttacgtacgtacgaactaaacgtgtaaataccgtaccgtaagtaacgtaacggtaaccggaaacgtaccggtaaccgggttccgttaggtttaaccgttaagtttaccggttacggttacgggtacccgggtaaagggtaacgttaacgggtaaacgggacgggggtaaagggggttacggggttacgggaaaccgggtaccggtaaaccgggttccgggtttaaccgggtttaaacccggg

SEQ ID NO: 266374 - DNA, 597 bp, Homo sapiens
  misc_feature: GYAE6OF01DY5U6.21.34.D01.1.454.CMB.1.raw
  modified_base (392)..(392): a, c, t, g, unknown or other
  misc_feature (392)..(392): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttatttagaaggtgtccagtgtgaggtgcagctggtggagtcgtgggggaggcttggtccaggccgtggggggtccctggagagtctcctgtgtgcctctggattcaagtttaatacctattggatgagctgggtccgccgaggctaccgaggggaaggggctgggaggtgggtggaccaaacgagtaaaaggaagagtaggaaagtagaacaaaaaggtntaggtaggactctaggtaggaaagggtccgtattacactatccgttacagaagaccaaacgaccaaagaactactactttatctagacaaagtagaatagacctagaagtaggtacgaagaaccgtacggactaggtagttagttacgtggtaggcggaagtagaagtacggacggtaggagggtggacgagacgcgtcgtacgg

SEQ ID NO: 266375 - DNA, 800 bp, Homo sapiens
  misc_feature: GYAE6OF01CZWT1.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaacgtggggctgagcgttgggttttccttgttgttatttagaaggtgtccagtgtgaggtgcagctggtggagtcgtggggggagtcgttggtccgaggccggtggggggtccctggaacgtagtcctccgtagtggtcggtcctcgtaggtattactaaagtttaactaccttattggatgagcgtcgggtccgccgaggcctaccgaggggaagggcgtgggacggttgggtacggaccgaaacgaaagtaaaagggaacgtaggtaagggaaacgtaaggaaaacgtaaaaaaggttgtaggtacggtaacttacgtaggtagggaaacgggtcccgtaagttaccgaaccctaagttccgttacaacgggtaacgaaaccgaaacccggaaccctaaaggtaaacccttacgttaaccttttaacgtaccgtacgtaaactaaacgtttaaggtaaacgtaccggtacccgttaagggaaaccggttaacgggtaaacccgggtaaacgaaccggttaacgggtccgtttagggttaaccgtttaacggttacgttagggtaccggtacgggaaaggtaggtaagttaacgggaccgggtaaggggtaacgggttacgggaacgtaaggacccggttcggttaccgtttaaccggg

SEQ ID NO: 266376 - DNA, 538 bp, Homo sapiens
  misc_feature: GYAE6OF01C80CW.21.34.D01.1.454.CMB.1.raw
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (527)..(527): a, c, t, g, unknown or other
  misc_feature (527)..(527): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccaggccgtggggggtccctgagagtctcctgtgtggcctctggattcaagtttaatacctattggatgagctggtccncaggctcgagggaagggctggagtgggtgacaacagtaaaggagagtgaagtagaanaaaagtgtgtaggactctgtagacgggtcgtagtaccacgtactcttacaagtagaacacgacaagaactctactttatctagactaaatgaatgacctagacgagtacgagacacggntacgtnttagtactgtgcgagagatacggagagggaggtaggangagcgtgtacg

SEQ ID NO: 266377 - DNA, 652 bp, Homo sapiens
  misc_feature: GYAE6OF01DEGIW.21.34.D01.1.454.CMB.1.raw
  modified_base (389)..(389): a, c, t, g, unknown or other
  misc_feature (389)..(389): n is a, c, g, or t
  modified_base (437)..(437): a, c, t, g, unknown or other
  misc_feature (437)..(437): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagcttgggttttccttgttgtttattttagaaggtgtccagtgtgaggtgcagctgggtggagtcgtgggggagcttgggtccaggccgtggggggtccctggagtagtctcctgtgtggcctctggattacaagtttaatacctattggatgagcgtggtccgccaggcctcgagggaagggctggaggtgggtcggaccaacaagtaaagggagatggaagtagaaacaaaagtntaggtaggactcgtggtaggaacgggccgtattaccactattccttanacgagaaccaacgaccaaagtaacctctacttatcctagaactaatacgaatacgcgtaagagtacggtacgaaggacctacgggtacttaggttacgttaagttaccgtaggttcggacggtaaggtaacggtaaggttaacgggaacggggtaaggggaacggggttaggggaacgggtaccgaacggggttcccgtttcccggggttaacgg

SEQ ID NO: 266378 - DNA, 738 bp, Homo sapiens
  misc_feature: GYAE6OF01A9B08.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagagactcaccatggaactggggctgagtcgttgggttttcctttgttagtttattttagtaaggtgtccagtgtgaggtgcagctgggtggtagtcgtgggggacgtcgttcggtccaggccggtcgggggtccctggacgacgtcgtccgtggtgtcgccgttcgtggtattactaagtttaactacgtagttgtaagtgtagtcggtacgggtccgaccgaggtcgtacggaagggggtagggcgtggggtaggtcggggtacggacctaaacgaaggtaaaagggaaggtacgtaagggtaaaggtaagaaaacgtaaaaaggtgtacggtaggtacgtacgtaggtaggtaacgggaccgtagttaacctacgtacgtttactaccgaaacggacaaaccgtaccgaaacccgtaaacgtaacttaacccgttatttactaaccgtagacttaaaggactaacgtacggtcctaaggaggtaaccgtaacgaaccgttacgacggtacgttagtacgttaacttcgggaggtccggaaggtacgtagtaaggtaacgggaggtaagggacgggtaggacgccggtaacggtccggttaccggtttaacg

SEQ ID NO: 266379 - DNA, 766 bp, Homo sapiens
  misc_feature: GYAE6OF01BLP5M.21.34.D01.1.454.CMB.1.raw
  modified_base (548)..(548): a, c, t, g, unknown or other
  misc_feature (548)..(548): n is a, c, g, or t
  modified_base (588)..(588): a, c, t, g, unknown or other
  misc_feature (588)..(588): n is a, c, g, or t
  modified_base (681)..(681): a, c, t, g, unknown or other
  misc_feature (681)..(681): n is a, c, g, or t
tcagtcgtcgctcgcacgaccggtgctcgatttagatcgtctgtgttgggttgggaaggtctcagagaggagccttagccctggactccaaggtcctttccacttggtgatcagcactgagcacgagaggactcaccagtggaacgtgggctgagtcgttgggtttccttgttgtttattttaggaaggttcgtacctaggtgtggtacggtgccgaggtcgttgggtggtacggtcggtaggggggtcgtcgttacggtcccgacggtcccggtcggggggtccctaggaggtacgttcgtccgtggtcggtcggacccttggtaggtactttacgtaaacgtttaactacctaggttcggtaatggacgtccggttacggtccccgcggtacggtccgtaccggaagggggcggtcgtgggtacggtacgggtcgaaccgtaaagaacgtaaaagggtactaggtaaggtaagtaaccgaaaagtaaacggtagtcggtacggtacgtcgtaagggacggtaaggcctagtacctcgtatccgtanaacggacgtaacaacgacgaacgtacttcgtatttaaccngtaacgtactaagtacgtaacgtaccgtacaggtaaacgtaccggtaacggtacggtaaccgtcggttacttagggttacgtttagtacgggngttaccggaggtaagttaacgggtaggcggtaaggggtcgtaaagggtcggaaagtccccgtagtaaccccgggtgttaaaccgg

SEQ ID NO: 266380 - DNA, 744 bp, Homo sapiens
  misc_feature: GYAE6OF01B6INP.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagcgtggtggagtcgtgggggagcgttggtccaggccggttggggggtcccctggagtagtcctccgtgtcggtggtcccgttcgtggtacttactaaagttttaactaccttagttggagtgacgtcggtcggggtcccgaccgacggtcctaccggaaggggtaacggggtccgtagggtaggtcggggtacggaccgtaaacgaagtaaaaggaggtaagtagggaagtaacgaaaacgtaaaaggtagtaggtacggtacttacggtaggtacggaagggaccgttaacgttaccaaccgtcgttacgttacgaacggtaacgtaaccgaaccgtaaccgaaacgtaaccttacgttaacctttataccgtacgtaacgtaaagtagtaacgtacgtaccgtaggaagtacggtaacgtaacgacgtaccgttacgtaggttacgttaacgttacgtcggttacgacggtaaggacgtaaggtacggggacggtaagggacgggtacggtacggacgtacggtcggttccggtttaacgg

SEQ ID NO: 266381 - DNA, 868 bp, Homo sapiens
  misc_feature: GYAE6OF01A4BC4.21.34.D01.1.454.CMB.1.raw
tcagtcgtcgctcgcacgaccggtgctcgatttagatcgtctgtgttgggtttgggaggtcgtcgagagaggagccttagccctggactccaaggcctttccagttggtgactcacgcacttgagcacagaggactcaccatcggactgggctgagcttgggtttccttgttacgttattttacgaggttctccgagtgtcgaggttcgcgcgtcgtacgggtggtacggtcggtacgggggacgtcgttcggttaccgacggtccggttcgggggtccccaggacgtacgtccttccgtgtcggtcgtcctcgtagacttacgtaagtttaactaccgttagttacggtactgtaacgtcggtaccgggtccgaccggacgtccgaccggtaagggacggtcgtacgggaaggttcggtacgtaccgtaaacgtaaggtaaaacggtagtaaccggttacgggaaacgtaaccggtaaacgtaaaaacggtcgttacgggtaacgtccgtttacggtagtaccggggtaaccgggtaccttaacgtttaccgaccgttacgttacccgttacgtaaccgaacgaaccgtaaccgtaaaccgtaaccgtaacccgtttagttaacccgtttacgttaaccgtacgtaaacgtaaacgtaggtttaaccacgggttacccgtaggttaacgacggtttaacgaaaccggttacgtaacggttccgttaacgttaacgtttacgttaaccgtacgtaacgggtaaacgggttaaccggaaggttacggttaaacgggtccggtaaaagggttccgggtaacggtaacgggttacccgtaccgggtttaaccggttcggtttaaacccggg

SEQ ID NO: 266382 - DNA, 661 bp, Homo sapiens
  misc_feature: GYAE6OF01D0DK5.21.34.D01.1.454.CMB.1.raw
  modified_base (187)..(187): a, c, t, g, unknown or other
  misc_feature (187)..(187): n is a, c, g, or t
  modified_base (510)..(510): a, c, t, g, unknown or other
  misc_feature (510)..(510): n is a, c, g, or t
  modified_base (621)..(621): a, c, t, g, unknown or other
  misc_feature (621)..(621): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccagtggaacgtgggctgagcgttggttttccttgttgttattttagaaggtntcagtgtgaggtgcagcgtggtggagtcgtgggggagtcgttggtccaggtccggtcgggggtcccaggtacgtagtcctccgtgtcggtcggtccctcgtaggtattactaaagtttaattacctagttgagtgagtcgtcggtccgccgaggctacggagggagggcgtgggtacgtgggtacgaccaaagaagtaaaggaagtagaggaagtagaaaactaaaagtcgtggtacggtaactgtagtaggaacggtacgtacgttaccacgacttcgtaacgaagaacgaacaaaccgacaaagtaacctcttaattactntaacgaaactaagttacgaacgttagcctaaggaaggtaaccgtaggtaaacgcgtaggttctagttagttaacgtagttcggagaggtaagtaggaacgtaggggacggngggttaaggaccggacgactacggtcgtcggtttaaacgg

SEQ ID NO: 266383 - DNA, 666 bp, Homo sapiens
  misc_feature: GYAE6OF01AHJ8M.21.34.D01.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (314)..(314): a, c, t, g, unknown or other
  misc_feature (314)..(314): n is a, c, g, or t
  modified_base (643)..(643): a, c, t, g, unknown or other
  misc_feature (643)..(643): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcttggtccngccgtgggggtccctgagngtctcctgtgtggcctcgtggtattcaagttttaataccttattggatggagtctggggtcccnccgaggcctccgaaggggacggggcgtgggaggtggggtcggaccgaaacgaagttaaaagggaagtagtagggaaagttacggaaacgaaaaaggttcgttaggtcgggtaaccttacggtaggtagggaaacggggtccccgtaatttacccgaacctactttacctttaccgaaggtaacgaacccaaaccgacccgaaagaaccttacctaacttttactcctagacctaaatcgaaatcgactagaagtacgtacgaagaccgcggtacgtagtagttactgtgtgaggtagtacggagtggacgggtaagggagggtaggganaccgtacgtcggtcgttaacggg

SEQ ID NO: 266384 - DNA, 828 bp, Homo sapiens
  misc_feature: GYAE6OF01DWKU9.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccagtggaacgtgggctgagtcgtttgggttttcctttgttgtttagttttagaaggtgtacctaggttgtggaggtgcgagtcgtggtaggtaggtcgggtgggggacgtcgttcggtccgaggtccgggtcgggggtccctaggaggtacgtcctccgtggttcggtcgtcctcgtaggtacttacgttaaacgtttaacttaccgttagttaggtagttaggacggtaccggttccggggtcccgtacccggtacgggtacccgttacccggggaaggggggtaaaccggggtcggttaggggtaacgggttcggggtacgggaaacccgtaaaacggtaaaaggtaaaaacgggaagtaaggtaacggtaaagtaaacggaaaacgtaaaaaggttggtacgtacggtacgtcgtaggtacggaacggtctactaccgtacgtattaccgttagaaacgtacgaaccgaaaccggtaacaacgtaacttacttaaccgtttatccgtaagtaaacgtaactaggtaactaccggtagaacgtaggaacgtaccggaaagtacgtaacgtagttcggttaagttacgttaacgtacgggttacgtaaggtaagtaggttaacgggcggtaaggggtacggggtaaacggggtacgtacggacccggttaccggtcgttaaccgggtttacg

SEQ ID NO: 266385 - DNA, 734 bp, Homo sapiens
  misc_feature: GYAE6OF01DBF2D.21.34.D01.1.454.CMB.1.raw
  modified_base (555)..(555): a, c, t, g, unknown or other
  misc_feature (555)..(555): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagtcgttgggttttccttgttgtttatttagaaggtgtcagtgtgaggtgcagcgtggtggagtcggtggggagtcgttacggtcaggccggtggggtccctgagcgtctcgtgtgtggtacctcgtaggtattactaaagtttactacgttagtggataggagcggtcgggtccgccgaggtccgtaccggaaggggacgggtcgtagggtagggtcgggtacgaaccgtaacgaaagtaaaacggaagtaggtacggaaagtaagtaaaacgtaaaagttagtaggtaggtacctacgtaggtagggaacggtcgtaacttacgaactactcttacgaagtaacgaaccgaaccgaacaaacgtaaccttacgtaacttacgtacgaacgtaactaaagtanaacgtacgacgtacggtaaggtaacgaaacggttaacgaccgtacggtacgtttacggttaacgtttaacgtttacggtacggtacggtaacggaaagggtaaggttaacggtaacgggaccgggtaaagggtagggtacggaacggtcgtaaacggtccggttaaccggtttaacggg

SEQ ID NO: 266386 - DNA, 624 bp, Homo sapiens
  misc_feature: GYAE6OF01DPBV4.21.34.D01.1.454.CMB.1.raw
  modified_base (201)..(201): a, c, t, g, unknown or other
  misc_feature (201)..(201): n is a, c, g, or t
  modified_base (223)..(223): a, c, t, g, unknown or other
  misc_feature (223)..(223): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (479)..(479): a, c, t, g, unknown or other
  misc_feature (479)..(479): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcttgggttttccttgttgttattttagaaggttgtcagtgtgaggtgnagcgtggtggagtcgtgggggngtcgttcggtccaggccggtggggggtccctggagacgtctccgtgtggtcggtcctcgtggtattactaaagtttaactacttattgatgngtcgtgggtccncgaggctcggaggggagggcgtgggaggtggcggacaaacgtaaagtaaaggagagtaggaagtagaaacaaaagtgtagtaggactgtaggtagaagggtctacttcacctatctcgaagacgaacacgacgaataacctctaactttacnctacgaataatagaaactcgacttaggacgacgtacgaaggacctacggtagttcggtagtttaacgtacgtgaggacggtagaagtacggtagggacgggagggtaacgggttacggaacggagtacggtcgttcggttaacgg

SEQ ID NO: 266387 - DNA, 982 bp, Homo sapiens
  misc_feature: GYAE6OF01D4BLB.21.34.D01.1.454.CMB.1.raw
tcagtcgtcgctcgcacgaccggtgctcgatttagatcgtctgtgttgggtttggggaggtctcagagaggagccttagccctggactccaaggcctttccacttgtgatcagcactgagcacagagactcaccatggaactggggctgagcttgggttttccttgttgttattttagaaggtgtccagtgtgaggtgcagcgtggtggagtcgtgggggaggtcgttggtccaggccgttggggggtcccctggagtacgttctccgttggtggtcggccttcgtggtactttactaaaggttttaaatacccttagttacggattaggagccgttcggggtccccgccgaacgggcgtacccggaagggggaacgggggccgttgggaaggttcggggtacggacccaaaacgtaaggtaaaaagggaacgaagtagggaaagttacgaaacgtaaaaaagttatagggtaggtaaccttcgtagggtacggaaaacggggtccccgttaaagttttacccgaaacccgttacgtttaccgtttaccgaaacggtaaacggaaaccccgtaaaaacccggtaacccgtaaaaacgggtaaaccccttttaaccccgttaaaccgttttttaaaccgttacccggttaaacggtaaacccgtaaaaaggtttacggtaaaaacgtttaaccgggtacccccgtttaaagggtaaaaccggggttaacgggtttaaaccccgggaaaaaaccggggttaaccccggttaaaccccgggggttacccgttttaacgggtttaacgggttttaaacccgtttttaaccgggttacggttaaccggggtaacccggtaaaaggggttaaacgggtaaaggtttaacccgggggaaaacggggttaacggggggtaaaacggggtttacgggggaaacggtacccggtaaacgggttcccccgggttaaacggggttttaacccgg

SEQ ID NO: 266388 - DNA, 858 bp, Homo sapiens
  misc_feature: GYAE6OF01DIG42.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttcctttgttgttattttagaaggtgtccagtgtgaggtgcagctggtggagtcggtgggggaggtcgttgggtccgacggccggttcgggggggtcccctaggaggtacggttcctccgttggttggtcggtcccttcgtggtacttactaaaagttttaaactaccttaagttaggaattggacggtcgttcggggtccccggaccgacgggtcccgtaccggaagggggtaagggggccgtagggggaggttggggtacggacccgaaagtaaagtaaaagggaagtagtacgggtaaagtaacggtaaaacgtaaaaaggtagttacggttaacgggaccttacgggtaggtacgggtaaacggggtcccgtaagtttaccaacccgtagtttacccgttacgaacggtaaacgaacccaaacccggtaaccgtaaactaaacccgtcttaaaccgttttaagtacccgtttaagaaccctaaaagttacggtaaaagttaccgggacccgttaaggaacggttaaccggtaaccgaaaggtaacccgtagggtaccgttagggttagtttaaacgttacgttcgggtacggaaccgggtaaggtaaggtaacgggtaacggtaaccggggtaaggggggcggggttaaagggaacgggttacaacgggggtaccctttccggggttaaacgg

SEQ ID NO: 266389 - DNA, 696 bp, Homo sapiens
  misc_feature: GYAE6OF01CILAB.21.34.D01.1.454.CMB.1.raw
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagtcttggtccaggccggtgggggtccctgagagtctcctgtggtcggcctcgtggatttcaaagtttaatacctattggatgagcgtgggtcccnccgaggcctaccgaggggagggctagggaggtgggtcgaccaanaagtaaaagganagtggaaagtagaaacgtaaaagtatggtaggactcgtggtacggaaacgggtcctattccaacctattaccttacgaaggtaacgaacccgaaaccggaccaaacggtaaaccttccgtaacttttaacgtcgtagaacctaaagtagtaactaacgaccgtagaacggtacgtaacggaaacgaccgaacggtaccttggtaacgtttagttaccgtagggtcggaacggtaaggtaaggtaacgttaagggacccgggtaaaggggtacgggggttaacgggaacggaaccgttacggtccggttcccgggtttaaaccgg

SEQ ID NO: 266390 - DNA, 777 bp, Homo sapiens
  misc_feature: GYAE6OF01AXMVV.21.34.D01.1.454.CMB.1.raw
  modified_base (495)..(495): a, c, t, g, unknown or other
  misc_feature (495)..(495): n is a, c, g, or t
tcagtcgtcgctcgcacgaccggtgctcgatttagatcgtctgtgttgggtttggggaggtctcagagaggagtccttagccctggacctccaaggtccctttccacttggtgatcagcactgagcacagaggactcaccatggaacgtggggctggagtcgttgggttttccttgttgttatttagaaggtgtccagtgtgaggtgcagcgtgggtggaggtcggtgggggacggtcgttcgggtccgacggtcccgggttcgggggggtcccctggacggtacgttcccgttccgtcggtcggtcggtcccttcgtacgggtaactttacgtaaagttttaactaccgttagttggagtggtacggcgttcggggaccccgccggacggtccgaaccggagggggaacgggtcgtagggtacgggtcgggtacgaaccaaacgaaggtaaaagggacgtagtaagggaacgtaaggtaaacgtaaaaaggttntacggtacgtaacgtcggtaggtacgggtaaaccggccttaactcccgaacctcgttaccctaacggaacggacaacccgtaaacccgaccgtaaacgtaacctttaccgttactttacacgtacaataagtaggaactacggactaggaacgtacgacgaaacggccgtaacgggtcttaggttaagttacgtacgtaggtacgacggtaagaacggtagtaacgggtacggtaagggttacgggtacggacgtaacggtcggttaccgttcggttaacgg

SEQ ID NO: 266391 - DNA, 796 bp, Homo sapiens
  misc_feature: GYAE6OF01ERYM4.21.34.D01.1.454.CMB.1.raw
tcagtcgtcgctcgcacgaccggtgctcgatttagatcgtctgtgttgggtttgggggaggtctcagagaggagccttagccctggactccaaggccctttccacttggtgatcagcactgagcacagaggactccacccatcggaaccgtggggcctggagtcgttgggttttccttgttgtttatttaggagtgtccagtgtgtaggtgcagtcgtggtaggtagttcgtgggggagtcgttggccagtccggtcggggggtcccctaggacgtacgtccgtcctcgtcgtcgtcctgtcggacttacgtaacgtttaacttacctagttcggaactggaccgtacgtccgggtccgccggtacggtccgtaccgggagggggtaacggggcgtagggacgggttcgggtacggaacctaacgaaggtaaaacgggtaagtaacgtagggtaacgtaacggtaaactaaaaaggttgtaggtacggtactaggtacgggtacggaacggggtcccgtaatacccgtaacccgttattaccgtttaacgaacgggtaacgaaacccggtaaactaaaccgaaactaaacccgttaccttaaccggttttacttacccgtagttaaacctaaagtacgtaaaattacccgggtaataacggtaaaggtacgggaacgtaacggtacggaccggttagttacggttagttacgttacgttgtacggtagtaggaaggttagaccggaggggtacgggtaaggtacgggtacgacggtacggtccgttggttaaacgg

SEQ ID NO: 266392 - DNA, 709 bp, Homo sapiens
  misc_feature: GYAE6OF01BT219.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcgtggggggtagcgttggtccaggccgtggggggtcccctggagtagtccttccgtgtggtcggcctgtggtattactaagtttaataacctattggatgagcgtcgggtccgccgacggtcctaccggaggggaggggtctgggaggtgggtcgaccaacaagtaaaggagagtaggaagtagaaacgtaaaagtgtaggtcggtactgtaggtagggtaacgggtaccgtacgttaccgacctagttacctaccgtaaggaacgaccgaaaccggaaccaaagtaaccttacctaacgttttatccgtagaacctaaatagtaacgtaacgtccgtaggtaacggtaaaggttaaccggaaaggacccggtaacgggtacgttaggttacggtaactttaccggttagggtacggacgggtaaggtaacgtaaggtacggggacgaagggggtaagggtacgggaggtaccgacggttccggttggttaaccgg

SEQ ID NO: 266393 - DNA, 568 bp, Homo sapiens
  misc_feature: GYAE6OF01A8LKQ.21.34.D01.1.454.CMB.1.raw
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (459)..(459): a, c, t, g, unknown or other
  misc_feature (459)..(459): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtggggggaggcttggtccaggccgtgggggggtccctgagagtctcctgtgnggcctctggattcaagtttaatacctattggatgagctgggtccnccaggctccgaggggagggctggagtgggtgccaaacagtaaagggaanagtaggaaagtgaaacaaaaaaggttntaggtggaacttcgtggtggaaaggggccctagttccaccatctacagacacaacgccaagactcactttanctgacaatgaatgctgagacgtagaagacgacggtctagttcgtattaccgtgtcggacgaggtagagtaggacggaggtacgggtggacgtagacgtcgttcgtacgg

SEQ ID NO: 266394 - DNA, 761 bp, Homo sapiens
  misc_feature: GYAE6OF01AU4VF.21.34.D01.1.454.CMB.1.raw
  modified_base (351)..(351): a, c, t, g, unknown or other
  misc_feature (351)..(351): n is a, c, g, or t
  modified_base (603)..(603): a, c, t, g, unknown or other
  misc_feature (603)..(603): n is a, c, g, or t
  modified_base (748)..(748): a, c, t, g, unknown or other
  misc_feature (748)..(748): n is a, c, g, or t
tcagtcgtcgctcgcacgaccggtgctcgatttagatcgtctgtgttgggtttggggaggtctcagagaggagccttagccctggactccaaggtcctttccacttggtgatcagcactgagcacagaggactcaccagtaggacgtggggctgagtcgttgggttttccttgttagtttattttaggaaggtgtcctagtgtggaggtgctagcgttggtacggtaggtcggtgggggaggtcgttggtccctaggtccggttcgggggtaccctggacgtacgttcctccgttgtcggtacgtccgttgtagtactttacgtaaagtttaactaaccttagttaggtanggtaacgtcgtcgggtacccgacgtacggtcctccgggaaggggtacgggcggtagggtacggttcgggtacgaccgtaaaacgtaacggtaaaaggtaacgtagtaaggtaaggttaagaaaacgtaaaagtagtaggtacgtaacgtcgttaggtacggaacggtcgtatacctacacttcgtgaacgtacgaactaaccgaacgtaataacctcgttaaccttacgtactagaaacgtaagtacgtaanaccgggtacgtaagaacggtagtaacgggtaaaacgccgtaacgggttaccttaggtaacgttaagtacggttccggacggtaagggaacgtaacgtaaggaccgggttacgggaaaagggttccggaaggtacgaccgttacgnggtttcccgttag

SEQ ID NO: 266395 - DNA, 888 bp, Homo sapiens
  misc_feature: GYAE6OF01C2OVH.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccagtggaactgggggctgagtcgttgggttttccttgtttgtttattttagaaggtctcagtgtgaggtgcgagcgtggtggtaggtcggtgggggagtcgttcggtcgacggtcccggttcggggggtcctggacgtcgttcctccgtggtcggtcgtccttcgtggtacttacgttaaagtttaacttaaccttagttaggagtacggtcggtccggtcggggtccccgaccgtaacgggcccgtacggggaaggggggaacggggtcggttaggggtacgggttcggggtaccgggaaccgaaaacggtaaaacgggtaaaaagggaaggtaaagggtaagggtaaaaggtaaacggtaaaaaacgtaaaaaggtttaggtagggttacggtaacgttacggtagggtaagggtaacggggtaccttaacgtacccgtaaccgttacgtttacccgttacgaaacggtaaacggaaacccaaacccggtaaaccgtaaaccgttaaacccgttaacctttaaccgtttaacgttaccgtaacggtaaactaaagttaacgtaacgttaaccggtacgtaacggtaacgtaacgggtaaccggtaaccgaaccggtaccgttacgttacggttaacggttaacgttcggtagggtcggtaacgggaaggttaagtacgggtaacgggaaaccgggttaggggaacggggttacgggacggtacggtcggttccggttacgggttaaccggg

SEQ ID NO: 266396 - DNA, 777 bp, Homo sapiens
  misc_feature: GYAE6OF01ESEA4.21.34.D01.1.454.CMB.1.raw
tcagtcgtcgctcgcacgaccggtgctcgatttagatcgtctgtggttgggttggggaggtctcagagaggaggcccttagccctggactcccaaggcctttccacttggtgatcagcactgagcacagaggactcaccatggaactgggctgagctgggtttctgttgttatttagagtgtcagtgtgagtgcagctggtggagtcgtgggggaggtcttggtccaggtccgtggggggtccctggaacgacgtctccgttaggtcgtcggtcccttcgtgggtactttaccgtaaaggttttaactaccgttagttcggaataggacgtcgttcggggtaccgccgtagggtccgttaccggaagggggtaacggggacctaggggtacgttcggggtaccggtaacccgtaaacgtaagttaaaacgggaacgtagtacgggtaaacgttacggaaacgtaaaaacgttcggtaggtacggaacgtacgtagggtaacggtaacgggtccgacgtttaccgacctaacgtccgtttacgagtaacgaacccgaaaccgtaccgaaaccggtaaccttacccgttaacgtttaacgtccgttacgaacgttaaacgtaggaacgtaccgacgttaggaacgtaacggtacgaaacggtaccgacggtaccgttaggttcgttaacttacggtacggtcgtaccggaaagtacgagttcgggtaacgagggttaacggtacgggaacggaaccgtcggtacgttcggttaaaccgg

SEQ ID NO: 266397 - DNA, 639 bp, Homo sapiens
  misc_feature: GYAE6OF01B168L.21.34.D01.1.454.CMB.1.raw
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcgtgggttttcctgttgttattttagaaggtgtccagtgtgaggtgcagctggtggagtcgtggggggagcgttggtccaggccgtggggggtccctggagagtctcctgtgtggccctagtggtattctaagtttaatacctattggatgagcgtgggtccgcaggctcgaggagggctggagtgggngaccaagaagtaaaggagagtaggaagtagaaacgaaaaagtgaggtaggactcgtggaggaaggggtccagttccacctntccgttacaaggacgaacaaaccgacccgaaagtaaacccttctaacctttagtacgtacgtacgtaaaatgggtaaataccgaccgttagggaagtacgtaaacggaacgtaccgacgggtccttaggtacttacggtttacgcggtacggtacggaagtaaggatcgggaagggtagggcgggtaggacgtacgaacggtccggtggttaacgg

SEQ ID NO: 266398 - DNA, 835 bp, Homo sapiens
  misc_feature: GYAE6OF01DLUJC.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagtcgttgggtttttccttgtttgtttaattttaggaaggtgtccagtgtgaggtgcgagcgtgggtggagtcggtgggggaggtcgttggtccagccggtcggggggtccctggagtacgtctccgtggtgtcggcctcgtggactactaaagtttaactacctattggactgacgtcgttcgggtccgccgaggccgtaccggaggggaacggggcgtagggagggtcgggtacggtaacccgaaaacgtaaaggtaaaaagggaagtaaggtaagggtaaaacggttaacggaaaaaacgtaaaaaaacggttagtacgggttaacgggtaaccttacggttaagggtaaccggggaaacgggggtacccgttaaagttaacccgaacccgtaactttacccgtttaacgaaacgggtaaacgaaaacccgaaaacccggaacccgtaaaaacggtaaacccttacccgttaaaccgtttttaactaccgttaacgaaacgttaaaacgtaggtaaaacgttaacggtaccgtaaggtaacggtaacggtacgggaaacgtaaccggacggtcgttaggttacgttaacttacgtcggtacgtacggtaaggaagtaggtaaacgaccggggaagggttaacgggtaggaacggaccgaaggttcccgttacggttaacgg

SEQ ID NO: 266399 - DNA, 824 bp, Homo sapiens
  misc_feature: GYAE6OF01BCZFB.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcttgggttttccttgttgttatttagaaggtgtccagtgtgaggtgcagcgtgggtggagtcgtgggggacgtcgttggtccagccggttcgggggtccctggagacgtctcctgtgtcggtcctcgtggtattctaaagtttaactacctattcggatcggagtcgtcgggtcccgaccgaggtcctccggaagggggtaacggggtcgtagggtagggttggggtacggaccgaaacgaagttaaaaagggacgtaagtacgggaaagtagaaacgaaaaagttcgtaggtacggtaacttcgtaggtacggtaacgggaccgttacgttaccacccgtacttccgttaacgaaggtaacgaacccgtaaaccgaacccgtaaaagtaaccccgttaacttaacccgttttaagtaccgttaacgtaaccgtaaagttaacggaacttaccggaccgttaaggaacggttaacggtaaccgggtaaacggtaaccccgtaacgggtaccggtttacggtttacggtttaaacgtttacccgggtttaagggttaggtaacccggtaaagggtaacgttagggtaaaccggggaacgggttaaccgggggtagggttaacgggtaacgggtaccctaccgggttaccggggttacccgggttaaacccgg

SEQ ID NO: 266400 - DNA, 712 bp, Homo sapiens
  misc_feature: GYAE6OF01B0IYG.21.34.D01.1.454.CMB.1.raw
  modified_base (469)..(469): a, c, t, g, unknown or other
  misc_feature (469)..(469): n is a, c, g, or t
  modified_base (558)..(558): a, c, t, g, unknown or other
  misc_feature (558)..(558): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcgtggggggaggtcgtttcgggtccaggtcccggttggggggggtcccctggacggtacgttcctccgtggttcggttgggcccttcgttgggtactttacgtaaaggttttaaactacccttaagttggaatggagtccgttcggggtccccgaccgacggccgtacccggaagggggaacggggtcgtggggagggttggggtacggacccaaacgaagtaaaagggaagagtaggaagtagaaacaaaaagtntaggtaggtactgtgtagggaacggcctattacgacctatcttacgaagtaacgaaccaaccgaccaaacgtaacctacctactttacnctagaactaaatagaactacgacgtaggaacgacgtacggaagacctacggtcttaggtacgttagttacgttgtaggacggaaggtagaaggttacggacggggtaagggcggggtaaggaccggtacgacgggtcccgttacgggttaacgg

SEQ ID NO: 266401 - DNA, 524 bp, Homo sapiens
  misc_feature: GYAE6OF02HBL15.21.34.D01.1.454.CMB.1.raw
  modified_base (311)..(311): a, c, t, g, unknown or other
  misc_feature (311)..(311): n is a, c, g, or t
  modified_base (375)..(375): a, c, t, g, unknown or other
  misc_feature (375)..(375): n is a, c, g, or t
  modified_base (411)..(411): a, c, t, g, unknown or other
  misc_feature (411)..(411): n is a, c, g, or t
tcagtcgtcgctcgcacgaccggtgctcgatttagatcgtctgtgttgggtttggggaaggtctcagagaggagtccttagccctggactccaaggccgtttccacttggtgatcagtcactgagcacagaggactcgaccaatggaactggggctgacgcctgggtttccttgttgttatttagaaggtgtccagtgtgaggtgcagctggtggagtctgggggagcttggtccagcctggggggtccctgagagtctcctgtgtggcctctggattcaagtttaatacctattggatgagctgggtccncaggctccagggaagggctggagtgggtgccaacataaaggaagatggaagtgaacaaaaagtntgtggactctgtgaagggcattcaccatcttcaganacaacgccaaagaactcactttatctagacaaatgaaatagcctgagagtacgaagacacggctgtgtattactgtgacgagagatagcgaggaggtggagcgagtctgtacg

SEQ ID NO: 266402 - DNA, 497 bp, Homo sapiens
  misc_feature: GYAE6OF02G1LRT.21.34.D01.1.454.CMB.1.raw
  modified_base (183)..(184): a, c, t, g, unknown or other
  misc_feature (183)..(184): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (191)..(192): a, c, t, g, unknown or other
  misc_feature (191)..(192): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (261)..(262): a, c, t, g, unknown or other
  misc_feature (261)..(262): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (285)..(285): a, c, t, g, unknown or other
  misc_feature (285)..(285): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcggcgttcggcgtaggtcgttcaagtagcnngngngtnngcngngngtcngggagctgcagctggggcctgagngtctctgngtgctctgntnattatactatgatgnngtgcgcngcncgaggaggngngngngngcagagaagagagagagagaagaagtagtagtgagtgtgtagaggacgtagtacactatctcgagacgacgacgacgaacgaactactacttactactacacaataatagtagtacgtagagacgtacgacgacgacgtacgtagtagtagttagtagtgtacgacgagtagagacggaggacggtaggagacgacgtcgtacgtacg

SEQ ID NO: 266403 - DNA, 791 bp, Homo sapiens
  misc_feature: GYAE6OF02HU48I.21.34.D01.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
  modified_base (444)..(444): a, c, t, g, unknown or other
  misc_feature (444)..(444): n is a, c, g, or t
tcagtcgtcgctcgcacgaccggtgctcgatttagatcgtctgtgttgggtttgggggtaggtctcagagaggagccttagccctggactccaaggcctttccacttggtgatcagcactgagcacagaggactcaccatggaactggggctgagctgggtttccttgttgttatttagaaggtgtccagtgtgaggtgcagctggtggagtcgtgggggagcgttggtcccagccgtggggggtccctggagacgtctccgtggtggtcggccctcgtaggtattacaaaaggtttttaanaccttagtttgggataggtaggcgttggggtccccncgaacggtctccgaagggggaaggggcctgggaagggtggggtcggacccaaaacaaggtaaaagggaaagagtagggtaaacggtagaaaactaaaaaaaggttntagggtacggaacctttcgtaggttaggggaaaacggggtcccgtaaattttacccgaaacccgtaacgtcctttaacgaacggaaacgaaaccgaaaacggtaaacccgaaacggaaaaaccgtaccgttaaacctttaaacgttacctttaacggaacctaaaaacgttaagtaaactaaaccggtaccctaaaggtaacgaacggttaacgaaaacggtaacccggaacgggtaccgtagtaacgggttaacttacggttacgtgtaccgggaaggtaaggtagtaaggtaacggaacgggtagggttaacgggagaaccggtagccggttacgggttaaccgg

SEQ ID NO: 266404 - DNA, 588 bp, Homo sapiens
  misc_feature: GYAE6OF02JC41U.21.34.D01.1.454.CMB.1.raw
  modified_base (386)..(386): a, c, t, g, unknown or other
  misc_feature (386)..(386): n is a, c, g, or t
  modified_base (463)..(463): a, c, t, g, unknown or other
  misc_feature (463)..(463): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggtttccttgttgttattttagaaggtgtccagtgtgaggtgcagctggtggagtcgtgggggaggcttggtccagccgtgggggtccctgagagtctcctgtgtggcctcgtggattcaagtttaatacctagttggatgagcgtgggtccgccgaggctccgagggaagggtctgggagtgggtggacctaacgaagtaaaggaagataggagtagaacgaaaaagtntagtaggactacgtgaggaacgggccagttacaccagtcttacgagagaacaacgccgaaagaacctcgtactttanctagaacaaactagaatacgctagaagagtacgaagaacgacgggctaggtcgtaatacgtgtagacggagaagagtaacggacggtaagggaggttagggagtacgacggtacgtggttaacgg

SEQ ID NO: 266405 - DNA, 536 bp, Homo sapiens
  misc_feature: GYAE6OF02JAPFW.21.34.D01.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtccctggagagtctcctgtgtggcctctggattcaagtttaatacctattggatgagctgggtcccgccaggctccaggggaagggctggagtgggtggccaacataaaggagatggaagtgaacaaaagtntgtaggactctgtgaagggccgattcaccatcttcagagacaacgccaagaactcacttatctagacaatgaatacgcctagagagtacgaagacgacggactgtagtattacgtgtgcggagagtagtaagcgaggaggtgggagcgacgtcgtagtacg

SEQ ID NO: 266406 - DNA, 645 bp, Homo sapiens
  misc_feature: GYAE6OF02HRUQR.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcgtgggttttcctgttgttatttagaaggtgtccagtgtgaggtgcagctggtggagtctgggggaggcttggtccagcctggggggtccctgagagtctcctgtgtggcctctggattcaagtttaatacctattggatgagctgggtccgccgaggcctccgagggaagggcgtggaggtgggtggccaacaagtaaaaggaagaagtaggaagtgaacgaaaaagtagtaggtaggactcgtagttaggaaggggcccgtaatttccgaacctagtcctttacaagtacgaacaaaccgaccaaaggaacctacctaacgtttaatactagacctaaatacgaaatagtacccgtaggaagtaggtaccgaaaggtacgaaccgggtctaggttacgttagtttacgtgttacggacggaaggtacggtaagtaacggacggtaacggggtaggggtcgggaaggcggaaggtccgttacggttaccgg

SEQ ID NO: 266407 - DNA, 532 bp, Homo sapiens
  misc_feature: GYAE6OF02IVZNQ.21.34.D01.1.454.CMB.1.raw
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtccctgagagtctcctgtgtggcctctggattcaagtttaatacctatggatgagctggtccgccaggctccgaggggaagggctggagtgggtggccaacagtaaaggagatggaagtagaacaaaagtatgtggactntgtgaaggcgattcacatcttacaganacaacgcaagaactcacttatctgacaatgaatagcctagacgagtagaacgacgacggctgtacgtattacgtgtgacggagagtagtaggcggaaggaggtaggagcgaggtctggtacg

SEQ ID NO: 266408 - DNA, 517 bp, Homo sapiens
  misc_feature: GYAE6OF02FUYFB.21.34.D01.1.454.CMB.1.raw
  modified_base (507)..(507): a, c, t, g, unknown or other
  misc_feature (507)..(507): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccaggctccagggaaggggctggagtgggtggccaacataaaggaagatggaagtgaacaaaagtatgtggactctgtgaagggccgattcaccatcttcagagacaacgccaagaactcactttatctgacaaatgaatagcctgagagtcgaagacacggctgtgtattactgtgcgagagatagcgaggaggtggagnagctcgtacg

SEQ ID NO: 266409 - DNA, 722 bp, Homo sapiens
  misc_feature: GYAE6OF02JOX8H.21.34.D01.1.454.CMB.1.raw
  modified_base (215)..(215): a, c, t, g, unknown or other
  misc_feature (215)..(215): n is a, c, g, or t
  modified_base (259)..(259): a, c, t, g, unknown or other
  misc_feature (259)..(259): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (501)..(501): a, c, t, g, unknown or other
  misc_feature (501)..(501): n is a, c, g, or t
tcagtcgtcgctcgcacgaccggtgctcgatttagatcgtctgtgttgggtttggggtagggtcgtcagagaggaggccttagccctggactccaaggcctttccaccttcggtgatcagcactgagcacagaggactcaccatggaactgggctgagctgggttttccttgttgttattttagaaggtgtccagtgtgaggtgcagctggtggngtctggggggagcttggtccgagccgttgggggggtccctgagngtctccgtgtaggtgccttctggattcaagtttaatacctattgatgagctgggtccncnggcctccgagggagggctggngtgggtggccaacataaaggagagtggaagagaacaaaaaggtatggacgggtactacgtaggtaggaaacggggctagtttaccgaacctagttccctagtagaaacgtaccgaaaccggcccgaaagtaaaccctacctaacgttttaactccgtttanaccgtaaaaagtcgtaaaacgtaacggacccgtttaggaaggtaacgttccgaaaaagggtaccccgtaacggggttaccttaaggtaccggtttaaagtttacccgtagggtttaacgccggggttaaaggaaggtttaaactaaccggggtcgggtaaaggggtaacgggggttggggaaccgtacggtaaccggggtctttaccccggggttaacggg

SEQ ID NO: 266410 - DNA, 611 bp, Homo sapiens
  misc_feature: GYAE6OF02F2WB9.21.34.D01.1.454.CMB.1.raw
  modified_base (393)..(393): a, c, t, g, unknown or other
  misc_feature (393)..(393): n is a, c, g, or t
  modified_base (583)..(583): a, c, t, g, unknown or other
  misc_feature (583)..(583): n is a, c, g, or t
tcagtcgtcgctcgcacgaccggtgctcgatttagatcgtctgtgttgggtttggggagggtctcagagaggagccttagccctggactccaaggcctttccacttggtgatcagcactgagcacagaggactcaccatggaactggggctgagctgggtttccttgttgttattttagaaggtgtccagtgtgaggtgcagctggtggagtctgggggagcttggtccagccgtggggggtccctgagagtctcctgtgtggcctctggacttcaagttttaatacctattggatgagctgggtcccgcaggctccgaggggaaggggctgggagtggggtcggccaaacgactaaaagggaagagtgggaaaggtcgaaacaaaaaaggtntaggtgggacttcgtggtagaaggggcccgaatttccgaacctattcttacgacgaagaccaaacgaccaaacggaacctctaacttttagtcttgactaaaagtgtaaatacgtacctaggaagtacgtacggaagacgacgggctagtagttattacgtgtacgcgtaagagacgttagcggtaaggngggttggagtcgacggacgttcgtacgg

SEQ ID NO: 266411 - DNA, 625 bp, Homo sapiens
  misc_feature: GYAE6OF02JDZ0X.21.34.D01.1.454.CMB.1.raw
  modified_base (397)..(397): a, c, t, g, unknown or other
  misc_feature (397)..(397): n is a, c, g, or t
  modified_base (479)..(479): a, c, t, g, unknown or other
  misc_feature (479)..(479): n is a, c, g, or t
tcagtcgtcgctcgcacgaccggtgctcgatttagatcgtctgtgttgggtttggggagggtctcagagaggagccttagccctggactccaaggcctttccacttggtgatcagcactgagcacagaggactcaccatggaactgggctgagctgggtttccttgttgttattttagaagtgtcagtgtgaggtgcagctggtggagtctgggggagcttggtccagcctggggggtccctgagagtctcctgtgtcggctctggattcgaagtttaatacctattggatgagctggggtccgccgaggctaccgagggggtaacggggcgttgggacggtggggtcggacccgaaacaagtaaaaggaagagtaggaagtgaaacaaaagtatgngatcgtgtggaaagggccgtattccacctataccgtttacagaacgaacaaaccggaccaaaggaaacctctaacgttttanacttacgacaaatagaaattaagccgtaggagtaacggtcgaaaaggtaccgaaggggtctacggttagtaacttaacgttgtaggcgtaaggaagagtaaggccggaagggaacgggttggaggtacgaaggccgttagtaacgg

SEQ ID NO: 266412 - DNA, 570 bp, Homo sapiens
  misc_feature: GYAE6OF02IIXYM.21.34.D01.1.454.CMB.1.raw
  modified_base (470)..(470): a, c, t, g, unknown or other
  misc_feature (470)..(470): n is a, c, g, or t
  modified_base (554)..(554): a, c, t, g, unknown or other
  misc_feature (554)..(554): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttcctgttgttattttagaaggtgtccagtgtgaggtgcagctggtggagtcgtgggggagcttggtccagcgtgggggtcctgagagtctctgtgtggcctctggattcaagttttaatacctattggattggagtcgttcggggtccgccaggctccgaaggggaacgggctgggaggtgggtcggaccaaagagtaaaaggaagagtggaagtgaaacaaaaaggtatggaggtaactcgtaggtaggaacgggtccgaatttcacctagttacttcgaagagacaacgaccaaagactcactttanctagacaaatgaatagctagagacgagaacgacagtctagcgttatactgtgacggaagagtagtagacgggaggtaggtggancgaggtacctggtacg

SEQ ID NO: 266413 - DNA, 719 bp, Homo sapiens
  misc_feature: GYAE6OF02I9DKV.21.34.D01.1.454.CMB.1.raw
  modified_base (287)..(287): a, c, t, g, unknown or other
  misc_feature (287)..(287): n is a, c, g, or t
tcagtcgtcgctcgcacgaccggtgctcgatttagatcgtctgtgttgggtttggggtagggtctcagagaggagccttagccctggactccaaggcctttccacttggtgatcagcactgagcacagaggactcaccatggaactgggctgagctgggtttccttgtgttatttagaagtgtccagtgtgaggtgcagctggtggagtcgtggggggagcttgggtccagccgtggggggtccctgagagtctcctggtgtcggcctcgtggattcaagttttaanaccttattgggattgagtcgtgggtccgccgaggctaccgaggggtaacggggcctagggacggtggggtcggaccaaacgaagtaaaagggaagagtaggtaaaggtagaaacgaaaaaagtgtaggtacggtaaccttcgtaggttagggaaaacgggggcccgttaaagtttcccgaacctaacgtttccgttaccgtaaaaggaacgaaccctaaaccggaacccaaaggtaaaccctaccgtaactttaacgtctacgtacctaaaagttcaaagtaccgtaccgttaacggaaggtacgtaacgaaacggtaaccaacgggtcttaggtacgttaattaccgtggttacgaaccggtaaggaaccgtaaggtaggaaccgggtaaggtacggggtacggtaagcggtaaggtccggttacggtcgg

SEQ ID NO: 266414 - DNA, 558 bp, Homo sapiens
  misc_feature: GYAE6OF02GG2MN.21.34.D01.1.454.CMB.1.raw
  modified_base (302)..(302): a, c, t, g, unknown or other
  misc_feature (302)..(302): n is a, c, g, or t
  modified_base (384)..(384): a, c, t, g, unknown or other
  misc_feature (384)..(384): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagagtgaggtgaaagtggtggagtcggggggagcttggtccaggccgggggggtcctgagactgtcctgtgaagtctctggattgtatagcagagattggatgcactgggtccnccagacttcgaggaaagggtctgggagtggggtggaccaaacataaaaccaagatgggaatgtagaagcactatggtgcctntgtggaggggccattcacaatctccagagacagtgaccaaagactcgttgtatctgacaaatggaacagcctagagacgccggaggaccgacggcctctacttattacgtgtcggaccgaccgggtatacgtcggcttacgtcgtagttcggccgttccggtcggggtacccgg

SEQ ID NO: 266415 - DNA, 663 bp, Homo sapiens
  misc_feature: GYAE6OF02JXP7S.21.34.D01.1.454.CMB.1.raw
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcttgggtccagccgtggggggtacctgagagtctcctgtgtggcctctggattcaagtttaatacctattggatgagctgggtccgcaggctccgaggggaggggctgggagtggggtggccaacgataaaggaagataggaagtgaacaaaagtatgtaggactctaggtggaaagggccgaagtttccaccgtaacttcttcgtaacgaggaaccaaccgaccaaaggaacctacgtacctttaagttcctaggacctaaaagttacgaaattaacggcccttagggaacgaagggttaccgaaaagtaaccgaacccgggtacttgggtaccgtttaaagttacccgtagttcgggacggtaacggtaaggtaattagggacccggtaaaggggaggggttacggacgggaacctagggacccttcggttaaccggg

SEQ ID NO: 266416 - DNA, 715 bp, Homo sapiens
  misc_feature: GYAE6OF02IUTYX.21.34.D01.1.454.CMB.1.raw
  modified_base (392)..(392): a, c, t, g, unknown or other
  misc_feature (392)..(392): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcttggtccagccgtgggggtccctgagagtctcctgtgtggcctctggattcaagttttaacaccttattggatgagctgggtccgcgaggctccggaggggaaggggctgggaggtgggtcggaccaaacagtaaaagggaagagtaggaagtagaaacgaaaaaggtntaggtaggactcgtaggtaggaacggggtcccgtagtttccgacctaacgttccgtttacgaaggtaacgaaccgtaaccggaacccaaaggtaaaccttacctaaaccttttaacttaccgttagtaacctaaaagttacggtaaataccgtaccgtaaggaacggtaacggtaaccgaaacggaaccgtaacgggttcttacggttacgttaacgtttacgtcggtacggaccggtaagggtaaacgtacggttaacgggaccgggtaaggggtacgggtacgggtaaccggaccggtaacggtcggttccggttaaccgg

SEQ ID NO: 266417 - DNA, 535 bp, Homo sapiens
  misc_feature: GYAE6OF02F70VF.21.34.D01.1.454.CMB.1.raw
  modified_base (505)..(505): a, c, t, g, unknown or other
  misc_feature (505)..(505): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcccgtggggggtcccctggagagtctcctgtgtggcctctggattcaagtttaatacctattggatgagctgggtccgcaggctccagggaaggggctggagtgggtggccaacgataaaggaagatggaagtagaacaaaaagtatagtggactctgtaggagggccgattcaccatcttcagagacaacgccaaagaactcactttatctgacaaatagaatagacctgagagtacgaagacgacggctgtagtattactgtgcgagaganagacgagggaggtggagcgagctcgtacgg

SEQ ID NO: 266418 - DNA, 582 bp, Homo sapiens
  misc_feature: GYAE6OF02JGA9Z.21.34.D01.1.454.CMB.1.raw
  modified_base (337)..(337): a, c, t, g, unknown or other
  misc_feature (337)..(337): n is a, c, g, or t
  modified_base (462)..(462): a, c, t, g, unknown or other
  misc_feature (462)..(462): n is a, c, g, or t
tcagtcgtcgctcgcacgaccggtgctcgatttagatcgtctgtgttgggtttgggggagggtctcagagaggagccttagccctggactccaaggcctttccacttggtgatcagcactgagcacagaggactcaccatggaactggggctgagctgggttttccttgttgttattttagaaggtgtccagtgtgaggtgcagcgtggtggagtcgtggggggaggcgttggtccagccgtggggggtccctgaggagtctcctgtgtggcctctggattcaagtttaatacctagttgatgagctgggtccgcaggctccgaggggagggctggngtgggtgccgaacgataaaggaagataggaagtgaaacaaaaggtatggtaggactcgtgtaggaagggaccgtatcgaccatcttacagtacgacaaccgacaaagaactctaactttatctanactaaatgaactagacctaggacgaggtacgaagtaccgacgtcgtgtacgttattacgtgtacggcgtaaggacgtaagacggcggaagggtaggacggtaggcaaggtcgtacggtcg

SEQ ID NO: 266419 - DNA, 540 bp, Homo sapiens
  misc_feature: GYAE6OF02HFRTI.21.34.D01.1.454.CMB.1.raw
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgccgaggctccgaggggaagggctgggagtgggtgccaacgagtaaaggagataggaagtgaacaaaagtagtgtaggactctgtgaagggcgattcacctatctcagagacaacgcaagacctcactttanactgacaaatgaaatgcctaggagagtacgaagacacggntagtagttatacgtgtagacggagagtataggcgagggtaggtggagcgaggtcgtcggtacg

SEQ ID NO: 266420 - DNA, 715 bp, Homo sapiens
  misc_feature: GYAE6OF02IQ6ZH.21.34.D01.1.454.CMB.1.raw
  modified_base (346)..(346): a, c, t, g, unknown or other
  misc_feature (346)..(346): n is a, c, g, or t
  modified_base (379)..(379): a, c, t, g, unknown or other
  misc_feature (379)..(379): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcgttggtccagccgtgggggtccctggagagtctctgtgtggcctctggattcaagtttaatacctattggatgagcgtgggtccgccaggctccgaagggagggctggagtgggtgaccaanagtaaaggaagagtggaagtagaacaaaaagtntaggtaggactcgtagtggaaacgggccgtattcgaaccgtattccgtttacgaagaacggtaacaaaccggtacccgaaaaggtaacccttacctaaaccgttttaactaccgttaggtaactaaaacgttagtaaaacttaacggtcccttaaggtaaacggtacggttaaaccggaaacggtaaccgaaccgggtaccttaaggttacggtttaaacgtttaccttacgggttaggtacccggtaaggtaaccggtaagttaacgggaacggtaacgggggaagggtttacggaaagggtaccgaacggttacggttacccggtttaaacggg

SEQ ID NO: 266421 - DNA, 694 bp, Homo sapiens
  misc_feature: GYAE6OF02JL9YW.21.34.D01.1.454.CMB.1.raw
  modified_base (344)..(344): a, c, t, g, unknown or other
  misc_feature (344)..(344): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagctgggttttccttgttgttattttagaaggtgtccagtgtgaggtgcagctggtggagtcgtgggggagtcgttggtccagccgtggggggtccctgagagtctctgtgtggcctctggacttcaagtttaatacctattggatgagcgtggtccgccaggctccgagggagggctggaggtgggtgccaanaagtaaaggaagagtaggaagtagaacgtaaaaagtgtgtaggactcgtagttaggaagggtaccgtattacgaacccgtattaccgttacgaagtaacgtaaccgaaacgaacccgaaaggtaaaccttaccgtaacgttttaactaccgttagaacctaaagtacgtaaaagttcgtaccgttaggaacgtacggtaacgtaaggtaaccgtacggacgttaggttacgttaatttaaccgttggttacgtacggtaaaggtaacggttaaggtaaccggtaccggggaaaggggttacggggttaagggaccggtaacggtacgggttacccgtacggtttaacggg

SEQ ID NO: 266422 - DNA, 591 bp, Homo sapiens
  misc_feature: GYAE6OF02GO639.21.34.D01.1.454.CMB.1.raw
  modified_base (270)..(270): a, c, t, g, unknown or other
  misc_feature (270)..(270): n is a, c, g, or t
  modified_base (515)..(515): a, c, t, g, unknown or other
  misc_feature (515)..(515): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttgggtccagccgtggggggtccctgagagtctcctgtgtggcctntggattcaagtttaatacctattggatgagcgtgggtccgccgaggctccgaggggaggggctggaggtgggtcgaccaacgaagtaaaggaagagtaggaagtagaaacaaaaagtagtaggtaggactcgtagtaggaacgggccgtattacgacctattccttacagagaccaacgaccaaagaacctactactttatctagactaatagaatagcgtagacgagtacgaacgacgacggtntgtagtattacgtgtagacgaaggtagagtaggacggaaggtacgggtaggacggacgtacggtacgtggttacgg

SEQ ID NO: 266423 - DNA, 588 bp, Homo sapiens
  misc_feature: GYAE6OF02HB8TR.21.34.D01.1.454.CMB.1.raw
  modified_base (307)..(307): a, c, t, g, unknown or other
  misc_feature (307)..(307): n is a, c, g, or t
  modified_base (435)..(435): a, c, t, g, unknown or other
  misc_feature (435)..(435): n is a, c, g, or t
  modified_base (469)..(469): a, c, t, g, unknown or other
  misc_feature (469)..(469): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagccgtggggggtccctgagagtctcctgtgtggcctctggattcaagtttaatacctattggatgagctgggtccncaggctccagggagggctgggagtgggtggccaacataaaaggagagtaggaagagaacaaaagttataggtggactctggtagaagggccattcaccatctcaagacgaacaacgccaaagaacctnaactttatctagacaaatgaaatacgcctagganacgtacgaaagaccgacgggccttaggtcgttaattacgtgtacggtacgaaggtaagagttaacgggacggtaaggggtagggttacgggagtaccgaacggtccgttacgggtacgg

SEQ ID NO: 266424 - DNA, 569 bp, Homo sapiens
  misc_feature: GYAE6OF02JY8MO.21.34.D01.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (453)..(453): a, c, t, g, unknown or other
  misc_feature (453)..(453): n is a, c, g, or t
  modified_base (456)..(456): a, c, t, g, unknown or other
  misc_feature (456)..(456): n is a, c, g, or t
  modified_base (514)..(514): a, c, t, g, unknown or other
  misc_feature (514)..(514): n is a, c, g, or t
  modified_base (552)..(552): a, c, t, g, unknown or other
  misc_feature (552)..(552): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcttggtccaggccgtggggggtccctgagagtctcctgtgtggcctcgtggattcaagtttaatacctattggatgagctgggtaccnccaggctccagggaagggctggagtgggtgccaacagtaaaggaagagtcggaagtgaacaaaaagtntggtggactcgtgtaggaagggccaagttcaaccgtattctcgaagtagacaacgtccaaagaactcaactttanccngacaaatagactagcctagacagtacgaaagtaccgacgactggtatactaccgttgngtaccggagtacgaagtcgacggagggtaggtacggancgaagtcctggttaacg

SEQ ID NO: 266425 - DNA, 579 bp, Homo sapiens
  misc_feature: GYAE6OF02HVFXC.21.34.D01.1.454.CMB.1.raw
  modified_base (401)..(401): a, c, t, g, unknown or other
  misc_feature (401)..(401): n is a, c, g, or t
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtggggggaggcttgggtcccaggccgtgggggggtcccctggagagtctcctgtgtggcctctggattcaagttttaataccttagttggattgagcgtgggtcccgccaggctccgaggggaacggggctgggaggtgggtggaccaacagtaaaagggaagagtaggaagtagaacaaaaaggtntaggtggactcgtgtgaagggcctagttcacctatcttacaganacaacgacaaagactctactttanctganaatagaatacgctagagacgtacgaagacgacgctgtagttattacgtgtagcgaagacgagtacggacggaagggacggtaggagacgagtaccgtggttacgg

SEQ ID NO: 266426 - DNA, 788 bp, Homo sapiens
  misc_feature: GYAE6OF02IVO7S.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagcgtggtgggagtcgtgggggagtcgttggtccaggccgtcgggggtccctggacgagtctcctggtgtcggcctcgtggtacttacgtaaagttttaactacccttagttggtacttggaacgtccgttcggggtcccgaccgacgggtccgttacccggaagggggaacgggggccgtaggggtaggttcggggtcggaccaaacgtaagtaaaaagggaacggtaagtaggaacgtaaggaaaacgtaaaaaaggttagtacggtaggtaaccgttcgtacgggtaacggtaaccggggtacccgtaacgttttaccgaacctacttaccgtttacgaaacggtaacgaaacccgaaaccgtaaaccgaaacgtaaaccttaccgtaacttttaacgtacgttacgtaccgtaaaagttagtaaacgtacgtaccgtaaggaagtaacggtaacggtaaacgaaccgtaacggtcttaggtagttaacgtttacgtacgtacgggtacggaaggtaacgaaggttaaccggagggtaaagggtgggtaacgggacggtaaccggcggtaccgttcgtaaccggg

SEQ ID NO: 266427 - DNA, 619 bp, Homo sapiens
  misc_feature: GYAE6OF02J0IIJ.21.34.D01.1.454.CMB.1.raw
  modified_base (489)..(489): a, c, t, g, unknown or other
  misc_feature (489)..(489): n is a, c, g, or t
  modified_base (522)..(522): a, c, t, g, unknown or other
  misc_feature (522)..(522): n is a, c, g, or t
  modified_base (525)..(525): a, c, t, g, unknown or other
  misc_feature (525)..(525): n is a, c, g, or t
  modified_base (573)..(573): a, c, t, g, unknown or other
  misc_feature (573)..(573): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggtttccttgttgttattttagaaggtgtccagtgtgaggtgcagctggtggagtcgtgggggaggtcgttggtccaggccgtcggggggtccctggagagtctcctggtgtggtcctcgtggtacttacgtaagttttaactacctagttggattggagtcgtgggtcccgaccgaggcctccgaggggtaggggctgggaggtgggtggccaaacgagtaaaaggaagagtaggaagtacgaacaaaaaggtatggaggtactcgtagaggaacggcgtacttcaaccgtatccgtacagtacgacaacggacaagactctacgttatcngataatcgaatcgctagaagagtaacgagacgngtntaggtattacgttacgtggtaccgaggaaacgtaggtactaacggggnggtaaggggcggtaaggaccgtacgaccgggttaccgtaggttacg

SEQ ID NO: 266428 - DNA, 553 bp, Homo sapiens
  misc_feature: GYAE6OF02GZ5VJ.21.34.D01.1.454.CMB.1.raw
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
  modified_base (535)..(535): a, c, t, g, unknown or other
  misc_feature (535)..(535): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagagttgtccagtgtgaggtgcagctggtggagtctgggggaggcttggtccaggccgtgggggtccctgagagtctcctgtgtgcctctggattcaagtttaatacctattggatgagtcgtgggtccgccaggctccgaggggaagggctggagtgggtgaccaacagtaaaggaagagtaggaagtagaacaaaaagtntagtaggactcgtagtagaaggccgagttcaccatactcagagacacgcaagactcacttanctagacaaatgaaatgcctagagagtacgaagaccaggtctagtacgtattactgtacgacggagtaagagtagacgaagggtaggtaggacgngacggtacgtcggttacg

SEQ ID NO: 266429 - DNA, 653 bp, Homo sapiens
  misc_feature: GYAE6OF02FYHYS.21.34.D01.1.454.CMB.1.raw
  modified_base (254)..(254): a, c, t, g, unknown or other
  misc_feature (254)..(254): n is a, c, g, or t
  modified_base (312)..(312): a, c, t, g, unknown or other
  misc_feature (312)..(312): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcgttggtccgagccgtggggggtccctgagngtctccgtgtgtgcctctggattcaagttaataccttagtggtatgagtctgggtccnccgaggctcgagggaagggcgtggaggtgggtggcccaaagtagtaaaggaagtagtagggaaagtgaaacaaaaaggtataggtaggactagtagtagaacgggacgtacgttacacctattcttcgaagacgaaccgaacgaccgaaaacgtaactacctaactttattactaggaactaaagtagtaaactacgaccgttaaggagtaacggttaacggaaacggaccgaccggtcgtggttaacgttatttacggtgtacggtacggaagggtacgtaaggtaacgccggggtaagggtagggttgggaacgtcgtaacggtacgtccgggttaacg

SEQ ID NO: 266430 - DNA, 592 bp, Homo sapiens
  misc_feature: GYAE6OF02FUELZ.21.34.D01.1.454.CMB.1.raw
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtggggggaggcttggtccagccgtgggggggtccctgagagtctccgtgtgtggcctctggattcaagtttaatacctattggatgagcgtgggtccgccaggctccgagggagggctggagtgggtgccaacataaaggagatggaagtgaacaaaaagtntgtaggactcgtgtggaagggcattcacatctnagagacaacgccaagaactcactttatctagactaaatgaatagacctaggaagacggtacgaaacggtaccgaacgggtacttaggttagttaacgtttacgttgggtacgcggtaaggaaggtaacgtaggacgggtaaggggtagggtcgggaacgcgtacggtccgttcggttaaccgg

SEQ ID NO: 266431 - DNA, 836 bp, Homo sapiens
  misc_feature: GYAE6OF02GM8OH.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttccttgttgttattttagaaggtgtccagtgtgaggtgcagcgtggtggagtcgtgggggaggtcgttggtccaggtccggtcggggggtccctggagagtcctccgtgtgtggcctcgtggattactaagtttaactacctagttggatgagcgtcgggtccgccgaggcctccggaaggggaaggggcgtagggaggtggggtacggaccgtaaacaagtaaaaggaagtagtaggaaagtagaaaactaaaaagtgtaggtagactcgtagtaggaacgggccgtaacttaccaaccgtattaccgttacgaaggtaacgaaacccgaaaccgaacccgaaaacggtaaacccttaccgttaaaccttttaactacctaacggtaaactaaaaagttacgtaaaagttaacgtacccgttaaggaaacggttaacggtaaccggtaaaaaccggtacccgttaaaccggggtaccgttttagggtttaaacggttttaaacgtttaacccggtttaggggtttacccgggtaaaccggggtaaaagggttaaaaggggtaaaccggttaaacggggtaccgggggtaaaaggggggttaaggggggttaccgggggaaacgggtaacccggtaaacggggtttccccggtttaacccgggtttaaaccggg

SEQ ID NO: 266432 - DNA, 685 bp, Homo sapiens
  misc_feature: GYAE6OF02JR27M.21.34.D01.1.454.CMB.1.raw
  modified_base (666)..(666): a, c, t, g, unknown or other
  misc_feature (666)..(666): n is a, c, g, or t
tcagtcgtcgctcgcacgaccggtgctcgatttagatcgtctgtgttgggtttggggtagggtcgtcagagaggagccttagccctggactccaagccttcctaccttggtgatcagcactgagcacagaggactcaccatggaactgggctgagctgggtttcctgttgttatttagaaggtgtccagtgtgaggtgcagctggtgagtctgggggagcttggtccagcctggggggtcctgagagtctcctgtgtggctctggattcaagtttaatacctattggatgagcgtggtccgccaggcctcgagggaagggctgggagtgggggtgccctaaagagttaaaagggaagtagtagggaaagttagaactaaaaaaaggttgtcggtaggaaccttcgtagttacgggaaaggggtcccgaacgtttcaacccgacttaccgtttgaaagtacggaacaaaccggtaccaaaggtaaacctaccgtaaccgtttactttagtaccggtaaccgtaaaatcgaaacgtttaagaccccgtttagaacggtaagtcggaaaacggtaccaacgggtctagttacggttaattacggtgtttacgaaccggtaggaaagttcgaaaggtcccgtaaggggtacggttcgggagtaacccggngggttccctacggttacgg

SEQ ID NO: 266433 - DNA, 730 bp, Homo sapiens
  misc_feature: GYAE6OF02JN55R.21.34.D01.1.454.CMB.1.raw
  modified_base (291)..(291): a, c, t, g, unknown or other
  misc_feature (291)..(291): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtggggggaggcgttgggtccaggccgtgggggggtccctggagagtctcctgtgtggcctctggattcaagtttaanaccttatggatgagcttgggtccgcaggctccgaggggaagggctggaggtgggtggaccaacgaagtaaaagggaagagtacggaagtagaaaacgaaaagttcgtaggtacggtacgttcgtaggttaggaaacgggggcctaagttttccgaacctacgttaccgtttacgaaaggtaacggtaaccgaaacccgggtaccaaaaagggtaacccttaccttaaacgtttttaacacgtttacggaacttaaaacgtaacgttaaactaacggtccgtagaacggtacggttaaccggtaaacggaaccgaccggggtatttaacgggttagtttacgttaaaccggtttgacgggtacgaaggggtaaacgtaagttaccggggacggtaagggttacggggtcggaggaccggtacggttcgttccggtaacgg

SEQ ID NO: 266434 - DNA, 722 bp, Homo sapiens
  misc_feature: GYAE6OF02I8VCO.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttatttagaaggtgtccagtgtgaggtgcagctggtggagtcgtgggggaggcttggtccagccgtgggggtccctgagagtctcctgtgtggcctctggtattcaagtttaataccttattggatgagcgtgggtcccgccaggctccgaggggaagggctgggaggtgggtcggccaaacgaagtaaaaggaagagtaggaaagtagaaactaaaaggtagtaggtaggactacgtggtaggaacggggtcccgtaagtttccgaacctacgttacctttacgaacggtaacgaaccgaaaacccgaccgaaaacgtaaacccttacctaaactttttacgtaccttacggtaaccaaaacttagtaaacgttacggacccgttagggtaaacggacggttaaccggaaaacggtcccggtaaacgggtccttacgggttaagtttaacgtttacggtgttacggaccgggtaaggaggtaagtacgggacgggtaagggggtagggttacgggaacgggtaccgaagggtacccgttacgggttaacgg

SEQ ID NO: 266435 - DNA, 712 bp, Homo sapiens
  misc_feature: GYAE6OF02JRGJX.21.34.D01.1.454.CMB.1.raw
  modified_base (273)..(273): a, c, t, g, unknown or other
  misc_feature (273)..(273): n is a, c, g, or t
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtgggggtccctgagagtctcctgtgtggcctctggnttcaagtttaactacctattcggatgagtcgtcgggtccgtccgaggcctaccgaggggaacggggcgtggggaacggtcggggtcgggaccaaacgaagtaaaacgggaagtagtaggaaaggtagaaacgtaaaaaggttagtaggtacggacgttacgtaggtaggaacggggtaccgtaagttaccaacccgtagttaccttacgaagtaacgtaaccgaaaccggacctaaaacgaaccgttaccttaactttaagccttacggaactaaagttagaaacttacggtaccgtaggtaacgtacggtaacggaaacggtaaccgacggggtaaccttggttaacttaacgttactacgggtcggtaacggaaggtaagtagtaacgggtcggaaggggtagggtcggagtaccgtacggtaccgtggttaaccgg

SEQ ID NO: 266436 - DNA, 803 bp, Homo sapiens
  misc_feature: GYAE6OF02I1J0W.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggtttccttgttgttatttagagtgtcagtgtgaggtgcagcgtggtggagtcgtgggggagtcgttggtccacggccgtggggggtccctggagtacgtctccgtggttcgcggtccttcgtggtactttaccgtaagtttaactaccgttagttggatggagtcggtcgggtccgccgaggtccgtaccggaagggggaacgggtccgtaggggtacgggttcggggtcgggaacctaaacgtaagtaaaagggaaaggtagtagggaaaggtaagaaaaccgtaaaaaggttacgtaggtaacgggtacttacgttgggtaacgggtaaacggggtaccgttaacgttaccctaaccgtactttaccgttacgaacggtaaacggaaaccgaaaccggtaaccgaaaacgttaaaccgtaccgttaaactttacgtacttacgactaaaacgttacgtaaactacggtaccgtaaaggtaacggtacggtaaaccgaaacggtaccgtaaccgggttagtacggttaacgttaacgttacggttaggtcggtaacggtaaggtaagtaacggtagggtaaccgggtaaggggtaacgggttacgggaacgtaccggtacggttacccgttacgggtttaaccgg

SEQ ID NO: 266437 - DNA, 691 bp, Homo sapiens
  misc_feature: GYAE6OF02GNQ7O.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagctgggttttccttgttgttattttagaagttgtccagtgtgaggtgcagctggtggagtcgtgggggagcttggtccagccgtgggggtccctgagagtctcctgtgtggcctcgtggtattcgaagtttaactacctattggatgagcgtgggtccgccaggcctccgaggggaagggcgtgggaggtggggtcggaccaagaagtaaaagggaagagtagggaaagtagaaacgaaaaagtagtaggtaggtactcgtaggtaggaacgggccgtactttacgaaccctatcctttacgaagtaacggaacctaaaccggacccaaaacggtaacctccgtaaaccttttataccgttagaacctaaaagtgaaagttaccgaccgttaaggagtaacggtacggaaacggtaccgaaccgggtaccgttaggttaacgttaatttaccgttgggtacgacgggtaagaaggtaacgtacgggacggaaggggtacgggtcgggaaacggtcccgagggtccgttacggttaaccgg

SEQ ID NO: 266438 - DNA, 684 bp, Homo sapiens
  misc_feature: GYAE6OF02HVEPL.21.34.D01.1.454.CMB.1.raw
  modified_base (196)..(196): a, c, t, g, unknown or other
  misc_feature (196)..(196): n is a, c, g, or t
  modified_base (580)..(580): a, c, t, g, unknown or other
  misc_feature (580)..(580): n is a, c, g, or t
  modified_base (627)..(627): a, c, t, g, unknown or other
  misc_feature (627)..(627): n is a, c, g, or t
tcagtcgtcgctcgcacgaccggtgctcgatttagatcgtctgtgttgggtttggggaggtctcagagaggagccttagccctggactccaagcctttccacttggtgatcagcactgagcacagaggactcaccatggaactggggctgagctgggtttccttgttgttatttagaaggtgtccagtgtgaggtncagctggtggagtcgtggggagcgttggtccagccgtggggggtccctggacgaggttcctcctggtgttggcctcgtggtacgttctaaggtttaaataccgttatagggtattggaagtcgtcgggtccgaccgtacggctcccgaagggaagggcgtgggagtgggtgcccgtaaagacgtaaaggaagagttaggaagtacggaaataaaaagtatagtaggacgttaactggagaacggggtccgaatttcccgaactacgttaccttacgaagaagaaccaaacgggtacccaaacgaaactaccgtaaactttaacttaaccgtagtaaccgtaaaattacgaaaataacgtacgttacgaaggttaagacgtaaanaaccgtaacgtgtacgtagttaagttaacgtaggtgtaccggaaagnggtaatacggaccggaaagggtttcgggaggtaaaggccgaacgtcctaggttaacg

SEQ ID NO: 266439 - DNA, 660 bp, Homo sapiens
  misc_feature: GYAE6OF02JOMZ1.21.34.D01.1.454.CMB.1.raw
  modified_base (639)..(639): a, c, t, g, unknown or other
  misc_feature (639)..(639): n is a, c, g, or t
tcagtcgtcgctcgcacgaccggtgctcgatttagatcgtctgtgttgggtttgggaaggtctcagagaggagccttagccctggactccgaaggcctttccacttggtgatcagcactgagcacagaggactcaccatgaactgggctgagcgtgggtttccttgttgttatttagaggtgtcagtgtgaggtgcagctggtggagtcgtgggggagcgttggtccaggccgtggggggtccctgagagtcctaccgtgtgtcggcctcgtggattcaaagtttaatacctattggatgagcgtggtccgccaggctccgagggaacgggctgggagtgggtgaccaacagtaaaacggaagagttaggaaagtagaaacgtaaaaagtagttaggtagaactccgtagtaggaaagggtccagtttcgaaccagttacgttactaaggaacgaacgtaaacccggacctaaaacggtaaacctacgtaacttttaacgtaccgtagtacctaaaagttcgtaaaatccggaacctaggaaacgtaggttaacgaaacgtaccgaacgtcgtagttacgtagtttaactcggttagacgaaggtaaagtgtaagacggaacgggtaggacggggtaanggtaggccgtacggttaacgg

SEQ ID NO: 266440 - DNA, 730 bp, Homo sapiens
  misc_feature: GYAE6OF02IKOZD.21.34.D01.1.454.CMB.1.raw
tcagtcgtcgctcgcacgaccggtgctcgatttagatcgtctgtggttgggtttgggaaggtctcagagaggagccttagccctggactccaaggcctttccacttggtgatcagcactgagcacagaggactcaccatggaacgtgggctgagcgttgggttttccttgttgttatttagaggtgtccagtgtgaggtgcagcgtggtggagtcgtgggggagtcgttggtccaggccgtgggggtccctggagagtctcgtgtgtggccttgtggattcaagttttaacacctaagttggattgacgtcgttcgggtcccgacgacggtccaccggtaaggggaacgggtccgtggggtaggttaggggcggaacccgaaagtaaagtaaaagggaacgtagtacgggtaaagtagaaacgtaaaaagtgtaggtaggaacttcgtaaggtacggaaagggtcctaacgttactaaccgagttacttacgaacgaacgtaaccaaaccggtacaaacgtaactactacttagtctagactaaatcgaaatcggactagggaagtacggtaacgtaacggaaccgtaacggcgtttaacgtacggtttaatttacccggaggttacgggaccggtaaagtaacggtaagtaaccggggtaccggttaaagggggtcggttacgggaaccggtacggtaaccgggttacccgttacgggtttaaaccggg

SEQ ID NO: 266441 - DNA, 519 bp, Homo sapiens
  misc_feature: GYAE6OF02HAE5K.21.34.D01.1.454.CMB.1.raw
  modified_base (410)..(410): a, c, t, g, unknown or other
  misc_feature (410)..(410): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggaggcttggtccagcctggggggtccctgagagtctcctgtgtggcctctggattcaagtttaatacctattggatgagctgggtccgcaggctccgagggagggctggagtgggtggccaacagtaaaggaagataggaagtgaacaaaaagtatgtggactctgtgaagggccattcaccatcttcaganacaacgccaagaactcacttatctgacaatgaatagctagagagtcgaagacacgtctgtagtattatgtgacggagagataggcgaggaggtggagcgagctcgtacg

SEQ ID NO: 266442 - DNA, 582 bp, Homo sapiens
  misc_feature: GYAE6OF02GSM3P.21.34.D01.1.454.CMB.1.raw
  modified_base (382)..(382): a, c, t, g, unknown or other
  misc_feature (382)..(382): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccaggcctggggggtccctgagagtctcctgtgtggcctctggattcaaagtttaataccttattaggatgagtctcgggtccgccaggcctccgagggaaggggctggagtgggtgccaagagtaaaggagataggaagtgaaacaaaagtntggtgactctagtgaagggcgtattcgaccattcttacagtaacgactaacgccaaaggactactaactttatctagtacaaatcgtaatagacctaggacgagtacgaaagacgacgtctaggttatacgttagtcgacggacggagtaagtatacgggacgagggtaggtggacggtacgtacggtccgtggttacgg

SEQ ID NO: 266443 - DNA, 712 bp, Homo sapiens
  misc_feature: GYAE6OF02JX83U.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagctgggtttccttgttgttatttagaagtgtccagtgtgaggtgcagctggtggagtcgtgggggaggcttggtccagccgtggggggtccctggagagtctcctgtgtggcctcgtggtattctaagtttaatacctattggatgagcgtgggtcccgcgacggctccgagggagggctgggagtgggtgaccaagacgtaaaggagataggaagtagaaacgtaaaaagtagtaggtacggactcgtaggtagggaaacgggccgtaagttacccgaacctagttccgtttaccgaaggtaaccggaaccgaaaccggtacctaaaaacgtaaccgttacctaaacgttttacgtactaaccggtaacaaaagttacgaaattacggtacccttagggaagtaacggttaacgaaacggtacccggtaacgtccgttagtacggtttaacttaaccgtgggtaccggtacggaaggtaacgttaacgtacgggtaaccgggaagggtttagggggacggtaaccggaccgtaaccggttacccggttaacggttaccgg

SEQ ID NO: 266444 - DNA, 781 bp, Homo sapiens
  misc_feature: GYAE6OF02IHB1A.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagctggtttccttgttgttatttagagtgtcagtgtgaggtgcagcgtggtggagtcgtgggggagcttggtccagccgtggggggtccctgagagtctcctgtcgtggccctgtggtattacgtaaagttttaaactaccttaagttggatggaggtcgttacggggtccccgaccgtaggggtcctaccgggaagggggaacgggggtcgttggggagggttcgggggtcggacccaaaacgtaaggttaaaagggaaacgtagtaagggaaaggtaacgaaaacgtaaaaaggtagttagggttacggaaccgttacgtagggttaacggaacggggtacccgtaaagttccaacccgttattacccgtttacgaagtaacggtaaaccaaaacccggaccctaaaaggtaaccctacgtttaaacgtttacctacgtagtaaacgtaaaacgttcgtaaaataccggtacttacggaaaggttaccgtacggaaaacggtaccgaacggtcttaggtaacctttagttaacgtacggtggtaaccgaggttaacggaacttaacggggacggttaacgggggtagggtaacggacgtacggtaccggttcggttacccggtttaggg

SEQ ID NO: 266445 - DNA, 666 bp, Homo sapiens
  misc_feature: GYAE6OF02GOX52.21.34.D01.1.454.CMB.1.raw
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (387)..(387): a, c, t, g, unknown or other
  misc_feature (387)..(387): n is a, c, g, or t
tcagtcgtcgctcgcacgaccggtgctcgatttagatcgtctgtgttgggtttggggaggtctcagagaggagccttagccctggactccaagggcctttccacttggtgatcagcactgagcacagaggactcaccatggaactggggctgagctgggttttcctgttgttattttagaaggtgtccagtgtgaggtgcagctggtggagtcgtgggggaggcttggtccagccgtggggggtccctggagagtctcctgtgtgcctcgtggattcacttcagtgacccanaacatggactggggtccnccgagctccgagggagggctggagtgggcggcgtagtacaaggaacgctaacagttacagtacagatacggcacgtntggtagaacggaggttacacgtatactacgaagtacgtatagtaacttaccgaaaagaacctacgtaaacgttacgtaactacgtacgaacgtaaaacttcggaaaccgacgtaccgtaaaccggtaaaaccggaccgggtaaaccgaccggggttaccgtaaggtttaacgttaacgttaggtacggtaaaacggtaaccgtaaaaagggacgggttaaggttaacggttagggttacgggtacggggttaagtccgttagggttacccgaacgtacg

SEQ ID NO: 266446 - DNA, 649 bp, Homo sapiens
  misc_feature: GYAE6OF02G8EYT.21.34.D01.1.454.CMB.1.raw
  modified_base (212)..(212): a, c, t, g, unknown or other
  misc_feature (212)..(212): n is a, c, g, or t
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (508)..(508): a, c, t, g, unknown or other
  misc_feature (508)..(508): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcgttgggttttccttgttgttattttagaaggtgtccagtgtgaggtgcagctggtggngtcgtgggggagcttggtccagccgtgggggtccctgngagtctccgtgngtggcctcgtggtattactaagtttaactaccgttagttaggtatggagtcgttacgggtcccgccgtacggcgtacggacggggacgggtcgtgggaggtgggtcggaccaacgaagtaaagggaagtagtaggtaagtagtaaacgaaaaagtgtagtaggactcgtagtaggaacgggtaccgtacttccgactagtcttcgaaagacgaaccagaccaaagtacctactacttatcacgaanaatagtaactacgtccgtagacgtaacggtacgaacggtaccgacggtctaggttagttaacgtttagtggtagaccggtaagtaggacgtaacggcgggaaagggcgggtacggacgacggtagcccgttaggttaacgg

SEQ ID NO: 266447 - DNA, 811 bp, Homo sapiens
  misc_feature: GYAE6OF02FIVSU.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcgttggtccaggcccgtgggggggtccctggagagttctcctggtgtggccttctggattcgtaagtttaacttacctatttgggatgagcgtgggtccgccgaggcctccgaggggaacggggtcgtgggagggttggggtacggtacccgaaacgaaggtaaaaagggaaaggtaacgtaggggaaagtagggaaaaccgaaaaaaaaggttacgttaggtacggggtaaccttacggtacgggttaggggaaaccgggggtacccgtaaacgttttaccgaaacccctaacgtttactttaaccgtaacggaacggtaaaccgaaacccggaacccgtaaaaaccggtaaaacccgttacctaaaccgtttttaacttaccgttacgtaaccgtaaaagttagtaaacttaacggtaccgttaacggaaggtaacggtaaccggtaaacgaaccgtaaccgggtaccgttagttacgttacgttttaacgttacggttacggaccggtaaaggaaggtagttaacgggacgggtaaggggacgggttaagggacggtaccgacgggtaccgttaccggttaaccgg

SEQ ID NO: 266448 - DNA, 644 bp, Homo sapiens
  misc_feature: GYAE6OF02GN0SU.21.34.D01.1.454.CMB.1.raw
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggaggcttggtccagccgtggggggtcccctggagagtctcctgtgtggcctctggattcaagtttaatacctattggatgagctgggtccgccgaggctccgaggggaaggggctgggagtgggtcggaccaaagagtaaaaggaagagtaggaaagtggaaacaaaaagttatagtaggacttacgtgtagggaaacggggtccgtaagtttaccaacccgtattacctttacgaacggaggaaacccaaaccggaccaaaacgaaccttactaacctttatacctagactaaatgaaatacgcctaggaagagtacgaaacgaccgtacgggtcttaggtagttaactacgttggtacgacgggaagtaacgagttaaggcggaagggtagggtacgggagaccgaagtccggtcgttacgg

SEQ ID NO: 266449 - DNA, 748 bp, Homo sapiens
  misc_feature: GYAE6OF02F7MK0.21.34.D01.1.454.CMB.1.raw
tcagtcgtcgctcgcacgaccggtgctcgatttagatcgtctgtgttgggtttgggggaggtctcagagaggagccttagccctggactccaaggcctttccacttggtgatcagcactgagcacagaggactcaccatggaactggggctgagcgtgggttttccttgttgttattttagaaggtgtccagtgtgaggtgcagctggtggagtcgtgggggaggcttggtccaggccgtggggggtccctggacgagtctccgtgtgtggcctcgtggattcaagtttaataccttattggatgagtcgtggtccgccgaggctccgagggaacggggctagggaggtgggtcggacccgaaacgtaagtaaaaacggggaagtaacgtagggtaaaggtagaaacaaaaaaggttagtacggtacggtaacttcgttagggtaacggtaaacggggtaccgtaacgtttaccgtaacctacgtttaccgtttacgaacggtaaccgaaaccgaaacccgaaccgtaaaacggtaacccttaacttaaccttttaagttaccgttacgtaaccgttaaaagtacgtaaagtaccggtaccgttaggaaaggtacgttaacggaaacgaaccggtacggtccgttaggttaacgttaagttacgttggtacggacggtaaggtaacgaaggtacggacgggtaagggacgggttagggaagaccggacggttccggtacggttaacgg

SEQ ID NO: 266450 - DNA, 832 bp, Homo sapiens
  misc_feature: GYAE6OF02GDMSF.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagctgggtttccttgttgttattttagaagtgtccagtgtgaggtgcagtctggtggagtcgtgggggagcgttggtccacggtccgttggggggtcccctggagtacgtcctccgtggtcgttcggccttcgtggtattacgtaaaggttttaacttaccttagttacggattacggagtcggtacgggtcccgcccggaacggtcctacggaacggggtaaggggtcctaagggtcgggtcggggtaccgaccgtaaacgtaaagtaaacgggaacgtaggtacggaaagttaacggaaacgaaaaagtttcgtacggtaggtaccgttaacgtaggtagggtaacgggtcccgtaaagtttcccgaaccgtacttccgtttaaccgaggtaaacgtaacccgtaaaccgtaaccgtaaacggtaaccctttacgtaaaccgttttacgtaccgttagtaaccgtaaaacgtttacggaaactttaacggaccgttaacggtaacggtaaggttaaccggaacggttaaaccgtaaccggggtccgttaaggttaccgtttaaggttaccgttacgggtaacggtacggtaaaggtaacggttaacggtaacggaacgggtagggttacgggtaccggggaacgttaccgggtacggttaccggtccccggtttaaagg

SEQ ID NO: 266451 - DNA, 735 bp, Homo sapiens
  misc_feature: GYAE6OF02HSUY1.21.34.D01.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (665)..(665): a, c, t, g, unknown or other
  misc_feature (665)..(665): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagcgtggtttcctgtgttatttagagtncagtgngagtgcagtctggtggcgtcgtggggacgcgttggtccngtccggtgggggtcccngaagtcgtctcgtgtggtcggccctgtggacttaccgtaaagttttaactaacccgttgttagggtaacttggaagtcggttcgggtaccccgtacgacggtccttaccggaaggggaaggggttccagggtagggttacggggtaccggtaacccgaaagtaagttaaaagggaaagtacgtaagggaaagttaccgaaaagtaaaaaagttcgttacggtcggtaaccttcgttacggtgaaaacgggggcctaacgtttaaccaacccggattaccgttaccgaaaggtaaccgaaccgttaaacccggacaaacggaaacttacccgttaactttaggtactcgaaacgtaataacggtaattaacgacgtacggagtagtaacgagtaccgacgttgcggtaaagtttactagtacggtntaaccggtagtaaggtacgaacggttaggaacgggttaaggcgaacggtacgacggttcgtacggttacg

SEQ ID NO: 266452 - DNA, 696 bp, Homo sapiens
  misc_feature: GYAE6OF02JUDW3.21.34.D01.1.454.CMB.1.raw
tcagtcgtcgctcgcacgaccggtgctcgatttagatcgtctgtgttgggtttggggaggtctcagagaggagccttagccctgactccaaggcctttccacttggtgatcagcactgagcacagaggactcaccatggaactggggctgagcttgggttttccttgttgttatttagaaggtgtccagtgtgaggtgcagctggtggagtcgtgggggaggtcttggtccaggccgtcggggggtccctgagacgtctccgtgtgtcgccgtctggtattactaagtttaactcctagttgatgagcgtacgggtccgccgacggtcgtaccgaaggggagggtctggaggtcgggtacggaccaaacgaagtaaaagggaagaggtaggtaagacgaaagtaaaagagtttaggtacggaacttcgttaggtaggaaacgggtctaacgttaccgtaacgacttcgtacaaggaacggaaaccgtaacgaaaccgaaacgtaaaccgttactaacctttagtaccttacgaactaacgtaagaaacttaggaccttaggaacggaaggtaccggaaacgtacggtacgtacgtgttaacttaacgttaccgtgtacggtacggaggtaataacgggtacggaacggtaagggtacgggaggtacggtacgtaacggttacgttccggttaacgg

SEQ ID NO: 266453 - DNA, 678 bp, Homo sapiens
  misc_feature: GYAE6OF02F9C9Q.21.34.D01.1.454.CMB.1.raw
  modified_base (583)..(583): a, c, t, g, unknown or other
  misc_feature (583)..(583): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcgtgggggaggcgttggtccaggccgtggggggtccctgagagtctcctgtgtggcctctggattctaagtttaatacctattggatgacgtcgtgggtcccgccgaggctaccggaggggtaaggggctaggggaggtggggtacggacccaaagaacgtaaaaggaagtaggtaggaaagtaggaaacaaaaaggttagtaggtaggacttcgtaggtaggaacggggaccgtattccgaacctattccgttacgagaacgaaccaaaccgacctaaaacggaaccttacctaacttttaacgtacgtacgaactaaaagtagaaactacgtaccgtagaaggtacggtacggaaaagccggaacgtnttgggttagttagttacgtgtacggagtaaggaacgtacgtaacggcggtaaagggtggggtaggaacgtacgtacggtaccgtaggttaaccgg

SEQ ID NO: 266454 - DNA, 841 bp, Homo sapiens
  misc_feature: GYAE6OF02IEWKD.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagcgtggtggaggtcgtggggggaggtcgttgggtccgaggtcccggttgggggggtcccgtggagtacgttccgttccgttggttggttcggccgtcgtggtacttactaagttttaaactaccttagttaggtatcggagtcgttcgggtcccgtccgaggtccgtaccggtaaggggaacggggtcgtagggtagggtcgggggttacggaccgtaaaacggaagttaaaaacgggaaggtaacgtagggaaagtaggaaaacgtaaaaagtacgttaggtaacggtaacgttcgtaggtaacggaacggggtacccgtactttaccgaacctaacgttccgttaacgaacggtaacgaaacccgtaacgaaaccgtaaacgtaaaccgttaccgttaaacgtttaacttacgttaacgtaactaaaacgtacgtaaataccggtacgtaacggaacggttaaaccgtacggaaacgtaaccggttaccgggtttagttaacgttaaaccgtttacgttacggtaacgggtccggtaaaggaacggttaaacggttaacgggaaccgggttaaggggtaagggttacggggaccggtaacgtaaccgggtactttaccggggtaaccttttaaccggg

SEQ ID NO: 266455 - DNA, 735 bp, Homo sapiens
  misc_feature: GYAE6OF02HXET4.21.34.D01.1.454.CMB.1.raw
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (627)..(627): a, c, t, g, unknown or other
  misc_feature (627)..(627): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcgttggtttaccttgttgtttaattttagaaggttcgcctaggtgtggaggtgcagcgtggtcggagttcggtagggggngtcgttcggtaccgaaccggttgggggtccctggagtacgtctccgttggacgtcggtcctgtacggtnttactaagtttaactaccgttagttggtagtagtacgtacgttcgggtccgcgtaggtaccccgtaccggaaggggtacggggtctgggtacggttacggggtacgaaccgtaaacgaaaggttaaaacgggagaaggttaggaaacgtaagtaaacgtaaaaagtcgtaggcgtaacgtgtacgtaggtaacggtcgtaacgttccgacgtacttccgtaactaggaacgaactaacccgaacgtaaacgaacccgtgtttaacttacctaacggttactaactaaagtaacgaataccggtacctaaggaacgttaccggaanaaaccgggtacgaaccggttgtaaccgttgtaccgttagtccgttagccggttagaacgttacggagtccggtaaggcggtaggcgtagacgtacgttgtaccggtta

SEQ ID NO: 266456 - DNA, 834 bp, Homo sapiens
  misc_feature: GYAE6OF02JJX6L.21.34.D01.1.454.CMB.1.raw
tcagtcgtcgctcgcacgaccggtgctcgatttagatcgtctgtgttgggtttgggaggtctcagagaggagccttagccctggactccaaggcctttccacttggtgatcagcactgagcacagaggactcaccatggaactgggctgagctgggttttcctgttgttattttagaaggtgtccagtgtgaggtgcagctggtggagtcgtgggggaggcgttggtccagccgtgggggtccctgagagtctcctgtgtgcctctggatctaagtttaatacctattggacgtgagcgttagggtcccgcacggctccgaggggaacgggcgtgggaggttggggtacggacccgtaaacgaagtaaaaagggaacgagttacggaaaggttagaaacgaaaaaagttacgtaggtagggtaaccttacgttaggtaagggaacggggtcccgtaaacgtttaccgaacccgtaacgttccgttttaaccgaacggtaaacggaacccgtaaaacccgtacccgaaaaacggaaaccctttaacgtaacccgtttttaacgttaccggttaacgtaccgtaaaaccgttaagaaaccgtaacggtacccgttaacggaacggttaacggtaacccggtaaaaggaaaccccgtaacggggttcccgttaaaggttaaccggtttaacgtttaaacccgtttgggttacgggtaacccggtaaagggtaacggttaaaccgtaaggggtaaccggttaaaggggtaacgggggtttaaccgggaaaggttaccccgggtaaacgggttacccggttaccgggtttaaccccggg

SEQ ID NO: 266457 - DNA, 719 bp, Homo sapiens
  misc_feature: GYAE6OF02GXNUR.21.34.D01.1.454.CMB.1.raw
tcagtcgtcgctcgcacgaccggtgctcgatttagatcgtctgtgttgggtttggggaggtctcagagaggagccttagcccctggactccaaggcctttccacttggtgatcagcactgagcacagaggactcaccatggaactggggctgagctgggttttccttgttgttattttagaaggtgtccagtgtgaggtgcagctgggtggagtcgtgggggaggcttggtccagtccgtggggggtccctgagtagtctcctgtgtggcctctggattctaagtttaataccttattggatgagcgtgggtcccgccgacggctaccgaagggggaacggggctggggtagtggggtacggaccctaaacgaagtaaaaagggaagagtacgggaaagtaggaaaacgtaaaaaggttatagggtacgaacgtcgtacggtaggaaacggggtccgtaatttaccgaaccgtaagttcccgttgtaaacgacggaaaccgaaacccgacccgaaaacgtaaccttactaaccgtttaacttacgtaacgtaactaaaacgtagtaaactacggaccgtaggaacgtacgtaaccgaaaggtaaccgaccgtgtagttaacgttagttacgttacggtcggtaagggacggtaagtaaggtaggtacgggaggggtaaggttaggggacggaccgtagggtaccgtaccggtttaacgg

SEQ ID NO: 266458 - DNA, 703 bp, Homo sapiens
  misc_feature: GYAE6OF02HHBH3.21.34.D01.1.454.CMB.1.raw
tcagtcgtcgctcgcacgaccggtgctcgatttagatcgtctgtgttgggtttgggaaggtctcagagaggagccttagccctggaatccaaggcctttccacttggtgatcagcactgagcacagaggactcaccatggaactggggctgagcttgggttttccttgttgttattttagaaggtgtccagtgtgaggtgcagctggtggagtcgtgggggagtcttggtccaggtccggtggggggtccctggagacgtcctcctgtgtcggcctcgtgattactaagtttaactacctagttggatagagtcgtgggtcccgccgaggtcgtccggaagggggtacggggtcgtagggcggttcgggtacggaccaaacgtaaggtaaaacggaagtacgtaaggaacgtagaaacaaaaagttagtgtacggtactcgtaggtacggaacgggtctacttcaaccgtattaccgttacgaacgtacgaaccgaacgaccaaacggtaaccttaccgtaacctttatactacggtaacaaactagaaacgtacgtacgtaagaacggtacgtacgaacggtaaccgtacggtacgtgttaacgttacgttacgttgttacggacggtaaggtaacgtaaggtaacgggtacggtaaggggtacgggtacggaaggtcggtaacggtcgttacggtaaccgg

SEQ ID NO: 266459 - DNA, 839 bp, Homo sapiens
  misc_feature: GYAE6OF02G6621.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttatttagaagttgtccagtgtgaggtgcagctggtggagtcgtggggggacgcttcgggtccgagccggtgggggggtcccctggagtacgtctccgtgtgtggcctcgtaggtacttacgtaaacgttttaactaccgttattgggaagtggtacgccggttcggggtcccgaccggtacggtccgtaccggtaagggggaagggggtccgtaggggtagggttacggggtacggtaacccgtaaaactaaagggtaaaaaaccggggaaggtaacggttaagggtaaacggtaacggtaaaaccggtaaaaaaagggttggttaggttaacggaacgtttaccgtagggttacgggaaacgggggtacccgtaaccgttttaacccgaaccttacgttacccgttacggtaaccggaacgtaaacccgaaaccggtaaccgaaaaacggtaacccttaacttaacgtttaacctacgttaaccgaactaaaaggtacgtaaacggtaacgtacccggtaaggaacgtaaaggttaccgaaacggtaacctacgggtcttaacggttaagttaacttcgtagttacggtaaccgaaggttaaccggaagtacggaacggtaggggtacggtaacgggtagtaccggtacgtaccggttacggtacgg

SEQ ID NO: 266460 - DNA, 584 bp, Homo sapiens
  misc_feature: GYAE6OF02FQOPX.21.34.D01.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (453)..(453): a, c, t, g, unknown or other
  misc_feature (453)..(453): n is a, c, g, or t
  modified_base (460)..(460): a, c, t, g, unknown or other
  misc_feature (460)..(460): n is a, c, g, or t
  modified_base (466)..(466): a, c, t, g, unknown or other
  misc_feature (466)..(466): n is a, c, g, or t
tcagtcgtcgctcgcacgaccggtgctcgatttagatcgtctgtgttgggtttggggaggtctcagagaggagcccttagccctggactccaaggcctttccacttggtgatcagcactgagcacagaggactcaccatggaactggggctgagcggtggtttacgtgtaggtactttagaagtcgcagtngagtncagtcnggtgagtcgtggggagtnttcggcaagccgtgggggtccnggagagtcnccgtgtggtgccttcgnggtattacaaggttttaaancctagttaggactgagcgtagtcngtagctccggaggaggnagtaggtcggagccaaagagtaaagntagacggtagacgaanaaaaggtgtagtgacctagtgacggagggacctagacactatcttagagacgaacacggactaaagacctacaactttgtancgtaaanaagtanactacgactagacgtacgaacgagaacgacgtgtagtagttacgtacgtagtacggacgtaaggtagtagtaacggtaggagtacgggtcgtaagacggtaacgtacgtacggttacg

SEQ ID NO: 266461 - DNA, 806 bp, Homo sapiens
  misc_feature: GYAE6OF02HXXPV.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagctgggtttccttgttgttatttagaaggtgtccagtgtgaggtgctagctggtgagtcggtgggggcgtcttggtccaggccgtcggggggtccctggagtagtcctccttggtcgtggcctcgtggactttacgaagttttaaactaccttagtttggatggacgtcgtcggggttaccccgccgtaacggtccgtaccgaaggggggtaacggggtcctgggggtaaggttcggggtaccggcccgaaaaacgtaagtaaaaagggaaagtaacgttagggaaacggtaagtaaaacgtaaaaaaggttcgtaaggttacggtaccttacgtaggtaacgggaaaccgggtaccgtaacgttaccctaacccgtaactttcgtttaaccgaacggtaacgaaacccgaaaccgtaaaccgtaaaacgtaaccttaccttaaactttaactacccgttaagaacctaaaaacgtagaaacttaccggtcctaaagtaaggtaacgtaccggaaaggtaacccggtaccggtagttaccgtgttaaacccgttaggttacggtacggaggtaaacggaaggttaaccgtaggaacggggtaagggtaacggggtggtaacggaacgtttacggtacgttcccgggttaaaccgg

SEQ ID NO: 266462 - DNA, 785 bp, Homo sapiens
  misc_feature: GYAE6OF02IA1SS.21.34.D01.1.454.CMB.1.raw
  modified_base (146)..(146): a, c, t, g, unknown or other
  misc_feature (146)..(146): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaaccatggaacgngggctgagcgtttgggtttccttgttgttatttagaggtgtccagtgtgtagtgcagcgtggtggagtcgtagggggagcgttggtcccaggtccggttcgggggtccctaggacgtcgttccgtacctggtcgtcggtccgtgtacgattaacgtaagtttaactaccttagttaggatacggtaaggtccggtaccgggtaccgccgtaacggtccgtaaccggaaggggacgggtcgtaagggacggttgggtacggaacccaagtaaaggtaaacgggaacgtggaaggtaaagttaaggaaacaaaagttagtacggtagtaaccgttcgtaggtaacggtacgggaccgtactaccgaacctacgttacgtacgaaggtaaccgaacgtaaaccgaccgtaaacgtaaccttaccgtaacgtttaacgtacgttacgaaacccttaaagtaaccgtaaacggtaacgtacggtacggttaaacggttaacggaaaccggtaaaccgtaacggtaccgttacgttaccggtaagttaacgttaacgtaggttaccgaaggtaacgaacgttaggaacgttaaccgggaggttaacgggacggttaaccgaccggtagacccgttaagttacggg

SEQ ID NO: 266463 - DNA, 759 bp, Homo sapiens
  misc_feature: GYAE6OF02FYBG9.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaaccatggaactgggctgagcttgggttttccttgttgttattttagaaggtgtccagtgtgaggtgcagctggtggagtcgtgggggacgtcgttggtccgaggccggttcggggggtccctaggacggtacgtcttccgtggtcggtcggtccttcgtggtattttaccgtaaaggttttaaacttacccgtaagtttggattcggacgtcgttcgggtacccgtccggaggtccgtacccggaaggggaacgggggcttaggggtacggttggggtacggacccaaagtaacgtaaaaggaagtaacggtaggtaaaggtacgtaaaacgaaaaaaggttaggtagtaacggtacctaacgtggtacgggtaaacgggacctacgttacaccgtattacgtaccaaagaacggaacctaaacgaccaaacgtaaacgtcctaactttacgtccgaacgtacaaagttacgaaactacgaccgttagaacggtacgtaccgaaagtacgacgttacgtggttaacgtaacgttcgttacgacggacggtaaggacttaacggacggtaacggaggggttaacgggtaggaacggttaccgagggttacccgtacggttaaccgg

SEQ ID NO: 266464 - DNA, 825 bp, Homo sapiens
  misc_feature: GYAE6OF02FLGZH.21.34.D01.1.454.CMB.1.raw
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactgggctgagcgtggttttcctgttgttatttagaaggtntccagtgtgaggtncagtcgtggtggacgtcggtgggggagcgttggtccaggtcccggtcggggggtcccngacggagttcctccgtggtcggtcggtccttcgtaggtactttaccgtaaagttttaacttacccgttagttacggtaagtaggtacggtcgttacggggtccccgtaccgtaacgggtcccgtaccgggaagggggaacggggtcgtacggggtagggtcggggtacggaaccctaaacgtaaaggtaaaacggaaggtacgtaggtaaagtacgtaaacgtaaaaagtcgtaggtacggtactcggtagtacggaacggggtacctacttaccgaaccttagttacctacgaacggtaacgaacgtaacccgaaccgtaaacgaaccttaccgtaactttacgttacgtaacgtacgtaaaacgtacgtaacgtaccgtacggttaacggaacggtaccggtaaccggaaaccggtacgtaaccgggtactttacgggttacgttaaaccgtttacgttaggtacgggtaaccgtaacgggtaaggtaaacgggttacggaaccggggttaagggtacggggtacgggtaacgtacgggtaccgttacccgggttacggtttaaccggg

SEQ ID NO: 266465 - DNA, 870 bp, Homo sapiens
  misc_feature: GYAE6OF02HJ89R.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaacgtggggctgagtcgttgggttttccttgttgtttattttaggaggtgtccagtgtgaggtgcagtcgtggtggtagtcggtggggggacgtcgttcggtacctacggtccggtcgggggggtccctaggaggtacgttcccgtcgttggtcggttcggcccttagtggtatttacgtaaaggttttaactaccgttagttgggtaagttcggaagcgttaggggtacccgccgacgggtctaaccggagggggtaacgggtccgtttagggggaaggtttcggggaccggggaacccctaaaaagtaaggttaaaaaacggggaagtaaggttaaccgggtaaaggtaacggaaaaacgtaaaaaggttaggtacgggtaggtaaaccgtttgaggggttaacgggaacggggtaccttataccgtaactacgttactttacgaacgaacgtaacaaaccggacctaaaacggtaacttacttaaacgtttacttacgtacggtaaacaaactttaacggtaaactaacggtacccgttaacggtaacggaaccggtttacggaaaaccggtaacgaacccgggttacgttaacggttacgttaacgttaccgtacggttacgggaaccggtaaaggttaacggtaaagggttacgaacgggggttaacgggtagggggtttaacgggaacggtttaccggaaggtcccggttaacggtttaaccgg

SEQ ID NO: 266466 - DNA, 688 bp, Homo sapiens
  misc_feature: GYAE6OF02GJM0G.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcgtgggttttccttgttgttattttagaaggtgtccagtgtgaggtgcagctggtggagtcgtgggggaggtcgttggtccagccgtcgggggtccctgagagtctctgtgtgctctggtattctaagttaatactagttggatgagtcgtgggtcccgccgaggtcgccggaggggaacggggcgtagggtacggtggggtcgaccgaaagaagtaaaaggaagagtacgggaagtagaaacgtaaaaggtagtaggtacggactacgtggtacggaacgggaccgtagttaccactactttcgttacgaagaacgaacaaaccggaccgaaacgtaacctactaactttactacgtacgaactaaagtcgaataccgaccgttagacggtaacgtaccggaaacgaccgtaacgggtcttacggttacgtttaacgttacgtggtacggtaggaacggtaagtacgggtaacgggccggggtaagggtacggggttacgggaccggacggtaacgggtccgttacggttacgg

SEQ ID NO: 266467 - DNA, 642 bp, Homo sapiens
  misc_feature: GYAE6OF02GA86G.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaggtgtccagtgtgaggtgcagctggtggagtcgtgggggagtcgttggtccagccgtcggggggtccctgagacgtctcctgtgtcgccttcgtggtattctaaagttttaacttaccttagttggatgagtcgtcgggtcccgccgaggtcctaccggaggggaacggggcgtaggggaggtggggtacggaccgaaacgaagtaaaaggaaggagtagggaagtagaaactaaaaggtagtaggtagaactgtggtaaggaacgggtcgtaacttaccactacttctacaagacgaaccgaaccgacctaaacgacctactaacctttatacctagtaactaaagttagaactagaccgttaggaacgtagtaacgaagaccgacgtacgttgtagttattcgtgtcgacggagagtagacggaggagggagggtggacggagacggtcgtacggttacg

SEQ ID NO: 266468 - DNA, 708 bp, Homo sapiens
  misc_feature: GYAE6OF02IDRD5.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctgggtggagtcggtgggggagtcttgggtccaggtccgtcggggggtccctggacgagttcctccgtggtgtggcccttcgtggtattcgtaaagttttaactacctagttggatggagtcgtcgggtccgccgacggcctaccggaaggggtaacggggccttaggggtaacgggttggggtcggaccgtaaaacgaaaggttaaaaagggaagtagtaacgggtaaggtaacgaaaacgtaaaaaagtgtaggtacggaacttcgtaggtacggaaacgggtcctagttaccgaacctagtcctttacgaagtacgaaccaacgaaccgaaagtaaacctctaactttactacgtacgaactaaagtagaaacgtacgccgttaagacgtaacgaccggaaagacgtaccggtacgttagtacgttaatcgtagtacggtacgtaaggtaagtagtacggacggtaaggcgggtaagtacgacggtacgtcgttcgttaacgg

SEQ ID NO: 266469 - DNA, 897 bp, Homo sapiens
  misc_feature: GYAE6OF02JKL8L.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagaggactcaccatggaactggggctgagcttgggttttccttgttgttatttagaaggtgtccagtgtgaggtgcagctggtggagtcgtgggggagcgttggtccaggccgtggggggtccctgagagtctccgtgtgtggcctcgtggtattcaagtttaataccttagttggatgagtcgtgggtacccgcacggctccggaggggaacggggtctagggaggttcggggtacggacctaaacgtaagtaaaacgggaagtaggtaggaaagtagaaacgtaaaaaggtgtaacggtaggtacttacgtggtaacggtaacggggccttaacgttcccgtaaccgtacgtttaccgttaacgaacggaacgtaaacccgtaaaacccggaccgtaaaaacggttaaacctttaaccccgttaaacgttttttaccgaaaccgtttaccggaaacctttaaaaacggttacgggttaaaacgttaccgggttaaccccgtttaaggggtaaaccggtttaaccgggttaaaccggtaaaacccgggtaacccggttaaaccgggttaccggtttaaacgggtttacggtttaaaaccgttttaacccgggttaagggttccggggtaaacccgggttaaacggggttaaacggtaaaacgggggttaacccgggacgggggttaaaaaccgggggtaacggggttttaaccggggaaaccgggtaccggtaaacccgggttaccgggttttacccgggtttaaaccgggg

SEQ ID NO: 266470 - DNA, 654 bp, Homo sapiens
  misc_feature: GYAE6OF02GU0YA.21.34.D01.1.454.CMB.1.raw
  modified_base (515)..(515): a, c, t, g, unknown or other
  misc_feature (515)..(515): n is a, c, g, or t
tcagtcgtcgctcgcacgaccggtgctcgatttagatcgtctgtgttggggtttggggaggtctcagagaggagccttagccctggactccaaggcctttccacttggtgatcagcactgagcacagaggactcaccatggaactggggctgagctgggttttccttgttgttattttagaaggtgtccagtgtgaggtgcagctggtggagtcgtgggggagcgttggtccagccgtggggggtccctgagagtctccgtgtgtggcctcgtgattcaagtttaactacctattggatgagctgggtcccgccgaggcctccgaggggaacgggcgtgggagtgggtcgccaacgagtaaaacggaagagtaggaaggtacgaaacgtaaaaagttagtaggtaggtacttactaggtaggaacgggccgtagtacccgacctagttaccttagaacgacgtaaccaaaccggaccaaaggtaacctaccgtactttatacgtagactaaagtnaaactagactaggaagtacgtaccggaaagaccgtacggtcttggtaacgttactttacggttgcggtacggaaggtaacgtaagtaacggacggtaagggtacggttggacgtacggaacgtccgttacggttaccgg

SEQ ID NO: 266471 - DNA, 730 bp, Homo sapiens
  misc_feature: GYAE6OF02IQ75T.21.34.D01.1.454.CMB.1.raw
tcagtcgtcgctcgcacgaccggtgctcgatttagatcgtctgtgttgggtttgggaaggtctcagagaggagccttagccctggactccaaggcctttccacttggtgatcagcactgagcacagagactcacatggaactggggctgagcgtgggttttccttgttgtttattttagaaggtgtccagtgtgaggtgcagctggtggagtcgtgggggagtcgttggtccaggtccggtggggggtccctaggagacgtctcctggtcgtggtccttcgtggtattactaagttttaactaccttaagttggagtacgagcgttgggtctcgccgtaggctaccggaggggagggcgtgggaggtgggtcgaccgaaacgtaagtaaaaggaagtagtaggaaagtagaaaacgtaaaagtagaggtagtactacgtaggtacgggtacgggtacctagttaccgacctacttaccgttcgaaaggtaaccgaaccgtaaaccgaacccgtaaagtaacctaccgttaacgtttaacttacccgtaggtaaaccgtaaagttaacgaaaacgttcgtaaccgttaagaaggtaacgtaacgaaaccgggacctaaccggtagtttagttacgttaacgttccgtaggtcgtaacggtaaggtaataacggtaacggtacgggtaagggtacggtagggaacggtaccggtacggtaccggttaaccgg

SEQ ID NO: 266472 - DNA, 811 bp, Homo sapiens
  misc_feature: GYAE6OF02F34XQ.21.34.D01.1.454.CMB.1.raw
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagtcgtcgctcgcacgaccggtgctcgatttagatcgtctgtgttggggtttgggaaggtctcagagaggagccttagccctggactccaaggcctttccacttggtgatcagcactgagcacagaggactcaccatggaacgtggggctgagcgttgggttttccttgttgtttattttagaagttgtccagtgtggaggtgacagtacgtgggtaggtaggtcggtgggggaggtcgttcgggtccgaaggtccggttcgggggggtccctaggagtacgttcgtccgtagtggcgtccgtctggtatactaagttaaatacctatggtatgagtcgtggtaccgcgtacggctacggaagggaggggctagggnggtacgggngtaccgaacgtaaggtaaaacggagaggtaggaagtacggtaaaacaaaaagtgttacggtaaggtaaccctagtggtaaacggaacggggtacctaacgtttcaaaccgtcgttaaccgttacgaacacggaaaccgaaaccggtaacctaaaacggtaaacctaacggttaaacctttactacgtacgtaaataaagtaaacgtaagtaaccggtcgttaaagaacgggttaacgtaaaccggggttaaacgacgggacggttaacgttaagggtaacgtttaaccgttaaggttaggttacgggtaaacggtaacggggtaaaccgttaaggggtaacggttaaacccgggggaagggggtaacggtacgggggttaaacggcccggtaaacggggtttcccttagggttaaaacccggg

SEQ ID NO: 266473 - DNA, 764 bp, Homo sapiens
  misc_feature: GYAE6OF02F0XJK.21.34.D01.1.454.CMB.1.raw
  modified_base (625)..(625): a, c, t, g, unknown or other
  misc_feature (625)..(625): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaacgtggggctggagtcgttgggttttccttgttgttatttagaggtgtccgtagtgtgaggtgagagcgtgggtggacgttcggtggggggacgtcgttcggtccaggtccggttacgggggtcctacggaggtacgttccgtccgtaggttcggcggtccttcgttaggtactttagttaacgttttaactaccttagttaggacgtgacggtccggtcggtccgaccgagggtctacggaaggggtaacgggtcggtaagggtcgggtcgggtcgaaccgtaacgtaaggtaaaaggacggtaagttaggaagtaacggtaaaacgttaaaaggttacggttaggacggtacttaccggtaggtacgggtaaccgggtacctagttaccaacgttattccgtagaaacggtccgaacgtaacgaaaccaacgtacctttactaactttgtacgtaagaaccttaaagtcctaaggtttaccngtaaacgtacgtagtaaacgaacggttccggaacgtccgtttaaaggtactttagttacgtggtaccgtagggacttaaggacttaaccgggaggtagggtacggtaggacctacggggtaacttccggtaggttaccg

SEQ ID NO: 266474 - DNA, 955 bp, Homo sapiens
  misc_feature: GYAE6OF02HXEY0.21.34.D01.1.454.CMB.1.raw
  modified_base (125)..(125): a, c, t, g, unknown or other
  misc_feature (125)..(125): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacngaggactcaccatggaactggggctgagctgggttttccttgttgttatttagaggtgtccagtgtcgaggtgcagtctggtggagtcgtggggggagtcgttggtccgacggtccgtgggggggtcccctggagtacgtctccgtggtgtggacctctggattcaagttttaactaccttagttgggatcggagtcgtcgggtcccgtccaagggccgttaccgaaggggaacggggtcgttagggacgggtggggtacggacccgaaacgtaagttaaaacggggaagaacggttagggtaaaacggttcggtaaaaacgtaaaaaaaaccggttgtaaggttacggggtaaccttcggttaggttaggggaaaaccggggtccgtaaacgtttacccgaaaccttaacttaccggttttaccgaaggttaaaccggaaacccggtaaaaccggtaccccgtaaaacgttaaccgtaaccccgtttaaacgttttaaccgttaccggtttaggtaaaccgttaaaaaaccttacggggtaaaaacttttaaaccgggacccgtttaaacggggtaacgggtaaacccggttcccgggtaaaaaacggtaacccgggttaaaccgggtaacccggtttaaccggttaacgggtttaaaaccgtttttaacccggtttacgggtttccggggtaaaccgggtaaagggggtaaaccggtaaacggttaaacgggggttaaccgggtaaccggggggttaagggtttaaccgggggtaaacgggaaccggtttaacgggttaaccccgggtttccggtttaaaacccgggg

SEQ ID NO: 266475 - DNA, 880 bp, Homo sapiens
  misc_feature: GYAE6OF02F3RW1.21.34.D01.1.454.CMB.1.raw
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactggggctgagcttgggttttccttgttgttattttagaaggtgtccagtgtgaggtgcagctgggtggaggtcgtggggggaggtcgttggtccgaggccggtcggggggtccctggagacgtcgtccgttgtcggtcggtcctcgtggtattacgtaaagtttaactaaccgttagttaggtagttggacggtcggtcggggtccccgaccggacgggtccgtaccgggaaggggggtaacggggtcggtaggggacgggttacgggggtacggaaccgtaaacgaaaggtaaaaacggggaagtaacggtagggtaaaggttaacggaaaacggtaaaaaggttaacgttagggtaacggtaacgttacggtagggtaacgggaaacggggtacccgtacttaaccgtaccgtacttaccttacggaacgtaacggtaaacccaaaccggaccgtaaaacgtaacccgttaccttaacgttttaacgtaccggtactaaacgtaaaactacgtaaacgttaccggtaccgttagggaaacggttacgggttaaaccgggaaacgttaaaccgggtaccgttaacgttaacggttaacgggtttaacctttaacggttggttacgggtaaacggaaccggttaaaggttaagggtaccgggtaaacggggggtacggggtaacggggttaccgggtaacggtacgggtaaccggtaccggtttcgggttaaaccgg

SEQ ID NO: 266476 - DNA, 721 bp, Homo sapiens
  misc_feature: GYAE6OF02GPE2T.21.34.D01.1.454.CMB.1.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
  modified_base (648)..(648): a, c, t, g, unknown or other
  misc_feature (648)..(648): n is a, c, g, or t
  modified_base (663)..(663): a, c, t, g, unknown or other
  misc_feature (663)..(663): n is a, c, g, or t
  modified_base (669)..(669): a, c, t, g, unknown or other
  misc_feature (669)..(669): n is a, c, g, or t
tcagtcgtcgctcgcacgaccggtgctcgatttagatcgtctgtgttgggtttggggaggtctcagagaggagccttagccctggactccaaggcctttccacttggtgatcagcactgagcacagaggactcaccatggaactgggctgagcgtggtttccttgttgttatttagaaggtgtccagtgtgaggtgcagctggtggagtcgtgggggnggcgttaggtccagccgtcgggggtccctgagagtcgtcngtgtggctctgattcgtaagttaatacctattggatggacgtcgtcgggtcccggaccgacggccgtaccgaacgggggtaacgggggtccggtagggaacggggttaggggtacccgggacccgaaaccgtaaaggttaaaaaggggaaaacggtaaggtaagggaaagggtaaacgtaaaaacgaaaaaaggtaacgggtttaagttaaggggaaccttaggtacgggttaggaaacggggtccgtaacttaaccgacctaagttcgttacgtacggaaacgtaaccaaaccgtaccaaaacgtaaaccgtacctacttttaagtacctagaaccttaaaagtcgtaacgtaagtacgtaacgagtacggtaagacgtaacgaccgtntaggtacttattagngtacgnggtaagagtactagggacgaggtagggtaggacgacggtgtacgtgtaacgg

SEQ ID NO: 266477 - DNA, 907 bp, Homo sapiens
  misc_feature: GYAE6OF02GQU38.21.34.D01.1.454.CMB.1.raw
tcagtcgtcgctcgcacgaccggtgctcgatttagatcgtctgtgttgggtttggggaggtctcagagaggagcccttagcccctggactcccaaaggcctttccgacttggtgatcagcactgagcacagaggactcaccatggaactgggctgagctgggttttccttgttgttattttagaaggtgtccagtgtgaggtgcagctggtggagtcgtgggggagcttggtccagccgtcgggggtccctgagacgtctccgtgtacgtgcctcgtggtattctaaagtttaactaaccttagttacggtattggagtcggtagggtacccgtaccgtacggcctaccgaaggggacggggtcgtagggtacgggtgggtacggaacccgaaacgtaacgttaaaaagggaaagtaagtaacgggaaaagtacggtaaaaacgaaaaaaggttacgtagggtagtaaccgttagtaacggtaagggaaaccgggtaccgtaacgtttacccgtaaacccgtaaccgttttacccgttaacgtaaacggaaacggtaaaccccgtaaaccggtaaacccgtaaaaacggtaaaacccttaacccgttaaacgttttaaccgttaaccgttaacgttaaaacccgttaaaaaggtaacgttaaaacgtaacggtaaccccgtaaaggtaaacggtaaccgttaaacccggtaaaagggtaacccgtaaccggggttaacgtttaaacggtttaacggttaaccgtttaacggtttacggtacgggttaacggtcggggttaaaacggtaaaccggtaagggtaaaccgggtaacggggggttttaaaacggggaacgggttaaccggaacccgggtaaacgggttaccggttaaccccgggttaaagg

SEQ ID NO: 266478 - DNA, 627 bp, Homo sapiens
  misc_feature: GYAE6OF02H8N8R.21.34.D01.1.454.CMB.1.raw
  modified_base (167)..(167): a, c, t, g, unknown or other
  misc_feature (167)..(167): n is a, c, g, or t
  modified_base (193)..(193): a, c, t, g, unknown or other
  misc_feature (193)..(193): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
  modified_base (489)..(489): a, c, t, g, unknown or other
  misc_feature (489)..(489): n is a, c, g, or t
  modified_base (578)..(578): a, c, t, g, unknown or other
  misc_feature (578)..(578): n is a, c, g, or t
tcagtcgtcgctcgcacgaccggtgctcgatttagatcgtctgtgttgggtttggggagtctcagagaggagccttagccctggactccaaggcctttccacttggtgatcagcactgagcacagagactcacatggaacgtgggctgagcttggttttccttgttnttatttagagtgtctagtgtagagtncagctggtgcgtgtggggatcgtgtcaggtcggtcggggtccngagtcttccgngtgtgtcgcctagtgtattacgtaagtttaacncgttagtggactggagtccgtcggtacccgcgtacggtccgtacggaggggtacggtcctagggtaccggtgggaccgactaaacgtaaggaaagggtanacgggttaagacgtaagaaacgtaaagtctggaggtactcgtaggacggacggtcaatccactatcgtanacgacaacacgtaacataccgtatacgttntacgactanaattacgaatccgtacaggtaacgtacggtaaccgaacgtccgaacgttcgttaaggtacttacgttagcgttaaggacgaaggtaagnggtaaccggacggtgtaggaggaaccgtccggtaattcgtacgttaccg

SEQ ID NO: 266479 - DNA, 224 bp, Homo sapiens
  misc_feature: GYAE6OF01DJMZ7.29.20.B09.1.454.CMB.1.raw
  modified_base (214)..(224): a, c, t, g, unknown or other
  misc_feature (214)..(224): n is a, c, g, or t
tcagatagagtactcacgaccggtgctcgatttagtgtagtgtgaagggtgccgagggaaccctggtcaccgtctcctcagcctccaccaaggcccatcggtcttccccctggcaccctcctccaagagcacctctggggcacagcggccctgggctgcctggtcaaggactacttcctctctcgactctgagcgggctggcaaggcgcatagnnnnnnnnnnn

SEQ ID NO: 266480 - DNA, 315 bp, Homo sapiens
  misc_feature: GYAE6OF01DAYKA.29.20.B09.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (252)..(254): a, c, t, g, unknown or other
  misc_feature (252)..(254): n is a, c, g, or t
  modified_base (256)..(257): a, c, t, g, unknown or other
  misc_feature (256)..(257): n is a, c, g, or t
  modified_base (261)..(262): a, c, t, g, unknown or other
  misc_feature (261)..(262): n is a, c, g, or t
  modified_base (267)..(267): a, c, t, g, unknown or other
  misc_feature (267)..(267): n is a, c, g, or t
  modified_base (269)..(270): a, c, t, g, unknown or other
  misc_feature (269)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (286)..(287): a, c, t, g, unknown or other
  misc_feature (286)..(287): n is a, c, g, or t
  modified_base (289)..(290): a, c, t, g, unknown or other
  misc_feature (289)..(290): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (307)..(308): a, c, t, g, unknown or other
  misc_feature (307)..(308): n is a, c, g, or t
  modified_base (310)..(315): a, c, t, g, unknown or other
  misc_feature (310)..(315): n is a, c, g, or t
tcagatagagtactcacgaccggtgctcgatttagtgtagtgtgaagggtgaccacgggaaccctaggtcaccgtctctcagacctccaccaagggcccatcggtcttccccctgggccacccgtcctccaagtagcacctctgggggcacagccgggccctgggctggcctggtcaggctattccatagctactcgtgaggccgggctggccaaggccgcatacgcncaggcatgctcccngcncncncannncnnggcnngcgcngnncngnagactctcananncnngngcggngngngagcgnnannnnnn

SEQ ID NO: 266481 - DNA, 353 bp, Homo sapiens
  misc_feature: GYAE6OF01BKCYP.29.20.B09.1.454.CMB.1.raw
  modified_base (350)..(353): a, c, t, g, unknown or other
  misc_feature (350)..(353): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggccctgggctgcctggtcaaggactacttcctatacgatcgctgagcgggctggcaaggcgcatagnnnn

SEQ ID NO: 266482 - DNA, 238 bp, Homo sapiens
  misc_feature: GYAE6OF01BS33R.29.20.B09.1.454.CMB.1.raw
  modified_base (220)..(238): a, c, t, g, unknown or other
  misc_feature (220)..(238): n is a, c, g, or t
tcagatagagtactcacgaccggtgctcgatttagtgtagtgtgaagggtggtccggagggaacctggtcgaccgtctcctacgagcctccaccaagggcccatcggtcttcccctggcaccctcctccaagagcacctctgggggcacagcggccctgggctgcctggtcaaggactacttcctcgatcgcgtctgagcgggctggcaaggcgcatagnnnnnnnnnnnnnnnnnnn

SEQ ID NO: 266483 - DNA, 214 bp, Homo sapiens
  misc_feature: GYAE6OF01BNFBQ.29.20.B09.1.454.CMB.1.raw
  modified_base (214)..(214): a, c, t, g, unknown or other
  misc_feature (214)..(214): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccatagcgtactctgagcgggctggcaaggcgcatagn

SEQ ID NO: 266484 - DNA, 214 bp, Homo sapiens
  misc_feature: GYAE6OF01BWG4X.29.20.B09.1.454.CMB.1.raw
  modified_base (214)..(214): a, c, t, g, unknown or other
  misc_feature (214)..(214): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctggggcacagcggccctgggctgcctggtcaaggactacttcctctctcgactctgagcgggctggcaaggcgcatagn

SEQ ID NO: 266485 - DNA, 356 bp, Homo sapiens
  misc_feature: GYAE6OF01CIL9C.29.20.B09.1.454.CMB.1.raw
  modified_base (352)..(356): a, c, t, g, unknown or other
  misc_feature (352)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaaagggcccatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 266486 - DNA, 353 bp, Homo sapiens; identical to SEQ ID NO: 266481
  misc_feature: GYAE6OF01EYCP6.29.20.B09.1.454.CMB.1.raw
  modified_base (350)..(353): a, c, t, g, unknown or other
  misc_feature (350)..(353): n is a, c, g, or t

SEQ ID NO: 266487 - DNA, 353 bp, Homo sapiens; identical to SEQ ID NO: 266481
  misc_feature: GYAE6OF01CCVIO.29.20.B09.1.454.CMB.1.raw
  modified_base (350)..(353): a, c, t, g, unknown or other
  misc_feature (350)..(353): n is a, c, g, or t

SEQ ID NO: 266488 - DNA, 356 bp, Homo sapiens
  misc_feature: GYAE6OF01D28YZ.29.20.B09.1.454.CMB.1.raw
  modified_base (352)..(356): a, c, t, g, unknown or other
  misc_feature (352)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctggggctgcctggtcaaggactacttcctatacgatcgctgagcgggctggcaaggcgcatagnnnnn

SEQ ID NO: 266489 - DNA, 352 bp, Homo sapiens
  misc_feature: GYAE6OF01EBRE3.29.20.B09.1.454.CMB.1.raw
  modified_base (351)..(352): a, c, t, g, unknown or other
  misc_feature (351)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 266490 - DNA, 395 bp, Homo sapiens
  misc_feature: GYAE6OF01AYW0F.29.20.B09.1.454.CMB.1.raw
  modified_base (367)..(395): a, c, t, g, unknown or other
  misc_feature (367)..(395): n is a, c, g, or t
tcagatagagtactcacgaccggtgctcgatttagtgtagtgtgaagggccgggtttcgaccatctccagagacaattccaacagcacgctgtatttgcacagtcgaacagcctgagaggcccgaggacacggccatatattattcgtgcgaaacttccttttgactggttattatcccctagtgaccacctggggccagggaaccctggtccaccgtctcctcagcctccaccaagggcccatcggtcttccccctggccaccctccgtccaagagcgacctctagggggctacagcggccctgggctgcctggtcaaggacctacgttccacgtgatcgactgagcggctggcaaggcgcatagnnnnnnnnnnnnnnnnnnnnnnnnnnnnn

SEQ ID NO: 266491 - DNA, 368 bp, Homo sapiens
  misc_feature: GYAE6OF01CM59I.29.20.B09.1.454.CMB.1.raw
  modified_base (353)..(368): a, c, t, g, unknown or other
  misc_feature (353)..(368): n is a, c, g, or t
tcagatagagtactcacgaccggtgctcgatttagtgtagtgtgaagggccgggttcaccatctccagagacaattccaacagcacgctgtatttgcacatgaacagcctgagagccgaggacacggccatatattattgtgcgaaacttcctttgactggttattatcccctagtgaccactggggccagggaaccctggtcaccgtctcctcagcctccaccaagggcccatcggtcttcccctggcaccctcctccaagagcacctctgggggcacagcggccctggggctgcctggtcaagggactacttccatagcgtactctagagcgggctggcaaggcgcatagnnnnnnnnnnnnnnnn

SEQ ID NO: 266492 - DNA, 356 bp, Homo sapiens
  misc_feature: GYAE6OF01C3COD.29.20.B09.1.454.CMB.1.raw
  modified_base (351)..(356): a, c, t, g, unknown or other
  misc_feature (351)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnn

SEQ ID NO: 266493 - DNA, 218 bp, Homo sapiens
  misc_feature: GYAE6OF01CWTH5.29.20.B09.1.454.CMB.1.raw
  modified_base (215)..(218): a, c, t, g, unknown or other
  misc_feature (215)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnnn

SEQ ID NO: 266494 - DNA, 227 bp, Homo sapiens
  misc_feature: GYAE6OF01ALJZZ.29.20.B09.1.454.CMB.1.raw
  modified_base (214)..(227): a, c, t, g, unknown or other
  misc_feature (214)..(227): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccatagcgtactctgagcgggctggcaaggcgcatagnnnnnnnnnnnnnn

SEQ ID NO: 266495 - DNA, 362 bp, Homo sapiens
  misc_feature: GYAE6OF01CM0HT.29.20.B09.1.454.CMB.1.raw
  modified_base (350)..(362): a, c, t, g, unknown or other
  misc_feature (350)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagacgcacctctggggcacagcggcctgggctgcctggtcaaggactacttcctatacgatcgctgagcggctggcaaggcgcatagnnnnnnnnnnnnn

SEQ ID NO: 266496 - DNA, 214 bp, Homo sapiens
  misc_feature: GYAE6OF01ECFFL.29.20.B09.1.454.CMB.1.raw
  modified_base (213)..(214): a, c, t, g, unknown or other
  misc_feature (213)..(214): n is a, c, g, or t
tcagatagagtactcacgaccggtgctcgatttagtgtagtgtgaagggtgccagggaaccctggtcaccgtctcctcagcctccaccaagggcccatctgtcttcccctggcaccctcctccaagagcacctctggggcacagcggccctgggctgcctggtcaaggactacttccagtatagtctctgagcgggctggcaaggcgcatagnn

SEQ ID NO: 266497 - DNA, 362 bp, Homo sapiens
  misc_feature: GYAE6OF01D0UPL.29.20.B09.1.454.CMB.1.raw
  modified_base (264)..(264): a, c, t, g, unknown or other
  misc_feature (264)..(264): n is a, c, g, or t
  modified_base (351)..(362): a, c, t, g, unknown or other
  misc_feature (351)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagngcacctctgggggcacagcggccctgggctgcctggtcaaggactacttcctatacgatcgctgagcgggctggcaaggcgcatagnnnnnnnnnnnn

SEQ ID NO: 266498 - DNA, 218 bp, Homo sapiens
  misc_feature: GYAE6OF01BS7N7.29.20.B09.1.454.CMB.1.raw
  modified_base (215)..(218): a, c, t, g, unknown or other
  misc_feature (215)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctcgatcgcgtctgagcgggctggcaaggcgcatagnnnn

SEQ ID NO: 266499 - DNA, 357 bp, Homo sapiens
  misc_feature: GYAE6OF01ATW5O.29.20.B09.1.454.CMB.1.raw
  modified_base (351)..(357): a, c, t, g, unknown or other
  misc_feature (351)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnnnn

SEQ ID NO: 266500 - DNA, 354 bp, Homo sapiens
  misc_feature: GYAE6OF01EI7GH.29.20.B09.1.454.CMB.1.raw
  modified_base (351)..(354): a, c, t, g, unknown or other
  misc_feature (351)..(354): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnn

SEQ ID NO: 266501 - DNA, 216 bp, Homo sapiens
  misc_feature: GYAE6OF01EVZY7.29.20.B09.1.454.CMB.1.raw
  modified_base (215)..(216): a, c, t, g, unknown or other
  misc_feature (215)..(216): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnn

SEQ ID NO: 266502 - DNA, 216 bp, Homo sapiens; identical to SEQ ID NO: 266501
  misc_feature: GYAE6OF01CR4R6.29.20.B09.1.454.CMB.1.raw
  modified_base (215)..(216): a, c, t, g, unknown or other
  misc_feature (215)..(216): n is a, c, g, or t

SEQ ID NO: 266503 - DNA, 215 bp, Homo sapiens
  misc_feature: GYAE6OF01EVS8I.29.20.B09.1.454.CMB.1.raw
  modified_base (215)..(215): a, c, t, g, unknown or other
  misc_feature (215)..(215): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagn

SEQ ID NO: 266504 - DNA, 216 bp, Homo sapiens; identical to SEQ ID NO: 266501
  misc_feature: GYAE6OF01BHRB8.29.20.B09.1.454.CMB.1.raw
  modified_base (215)..(216): a, c, t, g, unknown or other
  misc_feature (215)..(216): n is a, c, g, or t

SEQ ID NO: 266505 - DNA, 352 bp, Homo sapiens; identical to SEQ ID NO: 266489
  misc_feature: GYAE6OF01D50AG.29.20.B09.1.454.CMB.1.raw
  modified_base (351)..(352): a, c, t, g, unknown or other
  misc_feature (351)..(352): n is a, c, g, or t

SEQ ID NO: 266506 - DNA, 219 bp, Homo sapiens
  misc_feature: GYAE6OF01EBGZQ.29.20.B09.1.454.CMB.1.raw
  modified_base (217)..(219): a, c, t, g, unknown or other
  misc_feature (217)..(219): n is a, c, g, or t
tcagatagagtactcacgaccggtgctcgatttagtgtagtgtgaagggtgccagggaaccctggtcaccgtctcctcagcctccaccaagggcccatcggtcttccccctggcacctcctccaacgagcacctctgggggcgacagcggccctgggctgcctggtcaaggactacttcctctctcgactctgagcgggcgtggcaaggcgcatagnnn

SEQ ID NO: 266507 - DNA, 352 bp, Homo sapiens
  misc_feature: GYAE6OF01A2PN3.29.20.B09.1.454.CMB.1.raw
  modified_base (349)..(352): a, c, t, g, unknown or other
  misc_feature (349)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggccctgggctgcctggtcaaggctacttccatagcgtactctgagcgggctggcaaggcgcatagnnnn

SEQ ID NO: 266508 - DNA, 266 bp, Homo sapiens
  misc_feature: GYAE6OF01CH6P7.29.20.B09.1.454.CMB.1.raw
  modified_base (153)..(153): a, c, t, g, unknown or other
  misc_feature (153)..(153): n is a, c, g, or t
  modified_base (217)..(220): a, c, t, g, unknown or other
  misc_feature (217)..(220): n is a, c, g, or t
  modified_base (222)..(266): a, c, t, g, unknown or other
  misc_feature (222)..(266): n is a, c, g, or t
tcagatagagtactcacgaccggtgctcgatttagtgtagtgtgaagggtggtccggaggggaaccctggtcaccgtctcctcagcctccaccaagggcccactcggtcttccccctggcaccctcctccaagagcacctctgggggcacagnggccctgggctgcctggtcaaggctatcctcgatcgcgtctgagcggctggcaaggcgcatagnnnnannnnnnnnnnnnnnnnnnnnnnnnnnnnnnnnnnnnnnnnnnnnn

SEQ ID NO: 266509 - DNA, 217 bp, Homo sapiens
  misc_feature: GYAE6OF01A1TLL.29.20.B09.1.454.CMB.1.raw
  modified_base (215)..(217): a, c, t, g, unknown or other
  misc_feature (215)..(217): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnn

SEQ ID NO: 266510 - DNA, 216 bp, Homo sapiens; identical to SEQ ID NO: 266501
  misc_feature: GYAE6OF01CJCTX.29.20.B09.1.454.CMB.1.raw
  modified_base (215)..(216): a, c, t, g, unknown or other
  misc_feature (215)..(216): n is a, c, g, or t

SEQ ID NO: 266511 - DNA, 355 bp, Homo sapiens
  misc_feature: GYAE6OF01BVOI3.29.20.B09.1.454.CMB.1.raw
  modified_base (351)..(355): a, c, t, g, unknown or other
  misc_feature (351)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggctacttccatagcgtactctgagcgggctggcaaggcgcatagnnnnn

SEQ ID NO: 266512 - DNA, 217 bp, Homo sapiens; identical to SEQ ID NO: 266509
  misc_feature: GYAE6OF01AC452.29.20.B09.1.454.CMB.1.raw
  modified_base (215)..(217): a, c, t, g, unknown or other
  misc_feature (215)..(217): n is a, c, g, or t

SEQ ID NO: 266513 - DNA, 216 bp, Homo sapiens; identical to SEQ ID NO: 266501
  misc_feature: GYAE6OF01ECBRO.29.20.B09.1.454.CMB.1.raw
  modified_base (215)..(216): a, c, t, g, unknown or other
  misc_feature (215)..(216): n is a, c, g, or t

SEQ ID NO: 266514 - DNA, 224 bp, Homo sapiens
  misc_feature: GYAE6OF01B2SU5.29.20.B09.1.454.CMB.1.raw
  modified_base (216)..(224): a, c, t, g, unknown or other
  misc_feature (216)..(224): n is a, c, g, or t
tcagatagagtactcacgaccggtgctcgatttagtgtagtgtgaagggtgccagggaaccctggtcgaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnnnnnnn

SEQ ID NO: 266515 - DNA, 356 bp, Homo sapiens; identical to SEQ ID NO: 266492
  misc_feature: GYAE6OF01A7X4G.29.20.B09.1.454.CMB.1.raw
  modified_base (351)..(356): a, c, t, g, unknown or other
  misc_feature (351)..(356): n is a, c, g, or t

SEQ ID NO: 266516 - DNA, 222 bp, Homo sapiens
  misc_feature: GYAE6OF01C22B5.29.20.B09.1.454.CMB.1.raw
  modified_base (215)..(222): a, c, t, g, unknown or other
  misc_feature (215)..(222): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnnnnnn

SEQ ID NO: 266517 - DNA, 235 bp, Homo sapiens
  misc_feature: GYAE6OF01CIUHB.29.20.B09.1.454.CMB.1.raw
  modified_base (216)..(235): a, c, t, g, unknown or other
  misc_feature (216)..(235): n is a, c, g, or t
tcagatagagtactcacgaccggtgctcgatttagtgtagtgtgaagggtgccaggggaaccctggtcaccgtctcctcagcctccaccaagggcccatcggtcttccccctggcaccctcctccaagagcacctctgggggcacagcggccctgggctgccgtggtcaaggctacttcctctctcgactctgagcgggctggcaaggcgcatagnnnnnnnnnnnnnnnnnnnn

SEQ ID NO: 266518 - DNA, 229 bp, Homo sapiens
  misc_feature: GYAE6OF01BRDWC.29.20.B09.1.454.CMB.1.raw
  modified_base (219)..(229): a, c, t, g, unknown or other
  misc_feature (219)..(229): n is a, c, g, or t
tcagatagagtactcacgaccggtgctcgatttagtgtagtgtgaagggtgccgagggaaccctggtcaccgtctcctcagcctccaccaagggcccatcggtcttccccctggcaccctcctccaagagcacctctgggggcacagcgggccctgggctgccttggtcaaggactacttcctctctcgactctgagcgggctggcaaggcgcgatagnnnnnnnnnnn

SEQ ID NO: 266519 - DNA, 355 bp, Homo sapiens
  misc_feature: GYAE6OF01CFGFX.29.20.B09.1.454.CMB.1.raw
  modified_base (352)..(355): a, c, t, g, unknown or other
  misc_feature (352)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctggggctgcctggtcaaggactacttccatagcgtactctgagcgggctggcaaggcgcatagnnnn

SEQ ID NO: 266520 - DNA, 464 bp, Homo sapiens
  misc_feature: GYAE6OF01AXIBK.29.20.B09.1.454.CMB.1.raw
  modified_base (451)..(464): a, c, t, g, unknown or other
  misc_feature (451)..(464): n is a, c, g, or t
tcagatagagtactcacgaccggtgctcgatttagtgtagtgtgaagggccggttcaccatctccagagacaattacaacagcacgctgtatttgcacatgaacagcctgagagccgaggacacggccatatattattgtgacgtaactttcctttgacttggttattacctcccctagtcgaccacggtcggggccgaacgggaacccgtggtccacccgtcctcctcacgccctaccaaccgaacgggcccacgtccggttccccttccccccgtggaccctacccccttccctacccgaaaggacgcctaccctcgggtcgggggccaacgaggcccggtcccgtggggcctcggcccgttgggtaccgaaacgggtaccttaccgttacccgacggtgacgtccggacgtggacgggcggggctcgggacgaagggccgacagtagnnnnnnnnnnnnnn

SEQ ID NO: 266521 - DNA, 216 bp, Homo sapiens; identical to SEQ ID NO: 266501
  misc_feature: GYAE6OF01B81G4.29.20.B09.1.454.CMB.1.raw
  modified_base (215)..(216): a, c, t, g, unknown or other
  misc_feature (215)..(216): n is a, c, g, or t

SEQ ID NO: 266522 - DNA, 219 bp, Homo sapiens
  misc_feature: GYAE6OF01EORTB.29.20.B09.1.454.CMB.1.raw
  modified_base (219)..(219): a, c, t, g, unknown or other
  misc_feature (219)..(219): n is a, c, g, or t
tcagatagagtactcacgaccggtgctcgatttagtgtagtgtgaagggtgccgagggaaccctggtcaccgtctcctcagcctccaccaagggcccatcggtccttccccctggccaccctcctccaagagcacctcgtgggggcacagcggccctgggctgcctggtcaaggactacttcctctctcgactctgagcgggctggcaaggcgcatagn

SEQ ID NO: 266523 - DNA, 216 bp, Homo sapiens
  misc_feature: GYAE6OF01CJCV1.29.20.B09.1.454.CMB.1.raw
  modified_base (214)..(216): a, c, t, g, unknown or other
  misc_feature (214)..(216): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccacgtgatcgactgagcgggctggcaaggcgcatagnnn

SEQ ID NO: 266524 - DNA, 355 bp, Homo sapiens
  misc_feature: GYAE6OF01E17LA.29.20.B09.1.454.CMB.1.raw
  modified_base (351)..(355): a, c, t, g, unknown or other
  misc_feature (351)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 266525 - DNA, 217 bp, Homo sapiens; identical to SEQ ID NO: 266509
  misc_feature: GYAE6OF01D3ABI.29.20.B09.1.454.CMB.1.raw
  modified_base (215)..(217): a, c, t, g, unknown or other
  misc_feature (215)..(217): n is a, c, g, or t

SEQ ID NO: 266526 - DNA, 229 bp, Homo sapiens
  misc_feature: GYAE6OF01A6ZR7.29.20.B09.1.454.CMB.1.raw
  modified_base (217)..(229): a, c, t, g, unknown or other
  misc_feature (217)..(229): n is a, c, g, or t
tcagatagagtactcacgaccggtgctcgatttagtgtagtgtgaagggtgccagggaacccgtggtcaccgtctcctcagcctccaccaagggcccatcggtcttccccctggcaccctcctccaagagccacctctgggggcacagcggccctgggctgcctggtcaaggactacttcctctctcgactctgagcgggctggcaaggcgcatagnnnnnnnnnnnnn

SEQ ID NO: 266527 - DNA, 355 bp, Homo sapiens
  misc_feature: GYAE6OF01D6S38.29.20.B09.1.454.CMB.1.raw
  modified_base (349)..(355): a, c, t, g, unknown or other
  misc_feature (349)..(355): n is a, c, g, or t
tcagatagagtactcacgaccggtgctcgatttagtgtagtgtgaagggccggttcaccatctccagagacaattccaacagcatgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggcctgggctgcctgtcaaggactacttccgtactagacgctgagcgggctggcaaggcgcatagnnnnnnn

SEQ ID NO: 266528 - DNA, 246 bp, Homo sapiens
  misc_feature: GYAE6OF01D0I4A.29.20.B09.1.454.CMB.1.raw
  modified_base (216)..(246): a, c, t, g, unknown or other
  misc_feature (216)..(246): n is a, c, g, or t
tcagatagagtactcacgaccggtgctcgatttagtgtagtgtgaagggtgccggagggaaccctggtcaccgtctcctcagccgtccaccaagggcccatcggtcttcccccgtggcaccctcctccaagagcacctctggggcacagcggccctgggctgcctggtcaaggactacttcctctctcgactctgagcggctggcaggcgcatagnnnnnnnnnnnnnnnnnnnnnnnnnnnnnnn

SEQ ID NO: 266529 - DNA, 361 bp, Homo sapiens
  misc_feature: GYAE6OF01A06WQ.29.20.B09.1.454.CMB.1.raw
  modified_base (352)..(361): a, c, t, g, unknown or other
  misc_feature (352)..(361): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgccctggtcaaggactacttccacgtgatcgactgagcgggctggcaaggcgcatagnnnnnnnnnn

SEQ ID NO: 266530 - DNA, 355 bp, Homo sapiens
  misc_feature: GYAE6OF01A9312.29.20.B09.1.454.CMB.1.raw
  modified_base (350)..(355): a, c, t, g, unknown or other
  misc_feature (350)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcggctggcaaggcgcatagnnnnnn

SEQ ID NO: 266531 - DNA, 364 bp, Homo sapiens
  misc_feature: GYAE6OF01DW8YO.29.20.B09.1.454.CMB.1.raw
  modified_base (353)..(364): a, c, t, g, unknown or other
  misc_feature (353)..(364): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggccaccctcctccaagagcacctctgggggcacagcggccctggggctgcctggtcaaggactacttccagacgtatcactgagcgggctgggcaaggcgcatagnnnnnnnnnnnn

SEQ ID NO: 266532 - DNA, 352 bp, Homo sapiens
  misc_feature: GYAE6OF01CAGS4.29.20.B09.1.454.CMB.1.raw
  modified_base (349)..(352): a, c, t, g, unknown or other
  misc_feature (349)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctccaagagcacctctggggcacagcggccctgggctgcctggtcaaggactacttcctatacgatcgctgagcgggctggcaaggcgcatagnnnn

SEQ ID NO: 266533 - DNA, 242 bp, Homo sapiens
  misc_feature: GYAE6OF01DLW5A.29.20.B09.1.454.CMB.1.raw
  modified_base (215)..(242): a, c, t, g, unknown or other
  misc_feature (215)..(242): n is a, c, g, or t
tcagatagagtactcacgaccggtgctcgatttagtgtagtgtgaagggtggccgagggaaccctggtcaccgtctcctcagcctccaccaagggcccactcggtcttccccctggcaccctcctccaacgagcacctctgggggcacagcgccctggctgcctggtcaaggactactcctcgatcgcgtctgagcggcttggcaggcgcatagnnnnnnnnnnnnnnnnnnnnnnnnnnnn

SEQ ID NO: 266534 - DNA, 353 bp, Homo sapiens
  misc_feature: GYAE6OF01DOCZ7.29.20.B09.1.454.CMB.1.raw
  modified_base (350)..(353): a, c, t, g, unknown or other
  misc_feature (350)..(353): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctctccaagagcacctctgggggcacagcggccctgggctgcctggtcaaggactacttccatctacactactgagcgggctggcaaggcgcatagnnnn

SEQ ID NO: 266535 - DNA, 353 bp, Homo sapiens
  misc_feature: GYAE6OF01CI0D9.29.20.B09.1.454.CMB.1.raw
  modified_base (350)..(353): a, c, t, g, unknown or other
  misc_feature (350)..(353): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggtacagcggccctgggctgcctggtcaaggactactcctatacgatcgctgagcgggctggcaaggcgcatagnnnn

SEQ ID NO: 266536 - DNA, 215 bp, Homo sapiens
  misc_feature: GYAE6OF01BNHVZ.29.20.B09.1.454.CMB.1.raw
  modified_base (214)..(215): a, c, t, g, unknown or other
  misc_feature (214)..(215): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttcctctctcgactctgagcgggctggcaaggcgcatagnn

SEQ ID NO: 266537 - DNA, 215 bp, Homo sapiens; identical to SEQ ID NO: 266503
  misc_feature: GYAE6OF01E0DH6.29.20.B09.1.454.CMB.1.raw
  modified_base (215)..(215): a, c, t, g, unknown or other
  misc_feature (215)..(215): n is a, c, g, or t

SEQ ID NO: 266538 - DNA, 218 bp, Homo sapiens
  misc_feature: GYAE6OF01CPN3L.29.20.B09.1.454.CMB.1.raw
  modified_base (215)..(218): a, c, t, g, unknown or other
  misc_feature (215)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnn

SEQ ID NO: 266539 - DNA, 358 bp, Homo sapiens
  misc_feature: GYAE6OF01BP3HW.29.20.B09.1.454.CMB.1.raw
  modified_base (351)..(358): a, c, t, g, unknown or other
  misc_feature (351)..(358): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctggggcacagcggccctgggctgcctggtcaaggactacttccatagcgtactctgagcgggctggcaaggcgcatagnnnnnnnn

SEQ ID NO: 266540 - DNA, 360 bp, Homo sapiens
  misc_feature: GYAE6OF01B2ZFI.29.20.B09.1.454.CMB.1.raw
  modified_base (351)..(360): a, c, t, g, unknown or other
  misc_feature (351)..(360): n is a, c, g, or t
tcagatagagtactcacgaccggtgctcgatttagtgtagtgtgaagggccggttcaccatctccagagacaattccaacagcacgctgtatttgcacatgaacagccctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggctacttcctatacgatcgctgagcggctggcaaggcgcatagnnnnnnnnnn

SEQ ID NO: 266541 - DNA, 362 bp, Homo sapiens
  misc_feature: GYAE6OF01CZG0Y.29.20.B09.1.454.CMB.1.raw
  modified_base (331)..(331): a, c, t, g, unknown or other
  misc_feature (331)..(331): n is a, c, g, or t
  modified_base (355)..(362): a, c, t, g, unknown or other
  misc_feature (355)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccgaagggcccatcggtcttccccctggcacccctcctccaagagcacctcgtgggggcacagcggccctgggctgcctggtcaaggactacttcctcgtacgcactcngagcgggctggcaaggcgcatagnnnnnnnn

SEQ ID NO: 266542 - DNA, 355 bp, Homo sapiens
  misc_feature: GYAE6OF01DG6J6.29.20.B09.1.454.CMB.1.raw
  modified_base (352)..(355): a, c, t, g, unknown or other
  misc_feature (352)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctatacgatcgctgagcgggctggccaaggcgcatagnnnn

SEQ ID NO: 266543 - DNA, 356 bp, Homo sapiens
  misc_feature: GYAE6OF01ETJIU.29.20.B09.1.454.CMB.1.raw
  modified_base (350)..(356): a, c, t, g, unknown or other
  misc_feature (350)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttcctatacgatcgctgagcgggctggcaaggcgcatagnnnnnnn

SEQ ID NO: 266544 - DNA, 355 bp, Homo sapiens
  misc_feature: GYAE6OF01CRYNZ.29.20.B09.1.454.CMB.1.raw
  modified_base (350)..(355): a, c, t, g, unknown or other
  misc_feature (350)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctccaagagcacctctgggggcacagcggccctgggctgcctggtcaaggactacttcctatacgatcgctgagcgggctggcaaggcgcatagnnnnnn

SEQ ID NO: 266545 - DNA, 361 bp, Homo sapiens
  misc_feature: GYAE6OF01ED84E.29.20.B09.1.454.CMB.1.raw
  modified_base (352)..(361): a, c, t, g, unknown or other
  misc_feature (352)..(361): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctggggcacagcggccctgggctgcctggtcaaggactacttcctatacgatcgctgagcgggctggcaagggcgcatagnnnnnnnnnn

SEQ ID NO: 266546 - DNA, 361 bp, Homo sapiens
  misc_feature: GYAE6OF01C34VM.29.20.B09.1.454.CMB.1.raw
  modified_base (352)..(361): a, c, t, g, unknown or other
  misc_feature (352)..(361): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagacgcacctcgtgggggcacagcggccctgggctgcctggtcaaggactacttcctatacgatcgctgagcggctggcaaggcgcatagnnnnnnnnnn

SEQ ID NO: 266547 - DNA, 357 bp, Homo sapiens
  misc_feature: GYAE6OF01AWJHQ.29.20.B09.1.454.CMB.1.raw
  modified_base (346)..(346): a, c, t, g, unknown or other
  misc_feature (346)..(346): n is a, c, g, or t
  modified_base (352)..(357): a, c, t, g, unknown or other
  misc_feature (352)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttccctcgcgatatctgagcgggctggcaaggcncatagnnnnnn

SEQ ID NO: 266548 - DNA, 221 bp, Homo sapiens
  misc_feature: GYAE6OF01E4CB1.29.20.B09.1.454.CMB.1.raw
  modified_base (214)..(221): a, c, t, g, unknown or other
  misc_feature (214)..(221): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggctacttccagacgtatcactgagcgggctggcaaggcgcatagnnnnnnnn

SEQ ID NO: 266549 - DNA, 217 bp, Homo sapiens; identical to SEQ ID NO: 266509
  misc_feature: GYAE6OF01DTT0M.29.20.B09.1.454.CMB.1.raw
  modified_base (215)..(217): a, c, t, g, unknown or other
  misc_feature (215)..(217): n is a, c, g, or t

SEQ ID NO: 266550 - DNA, 351 bp, Homo sapiens
  misc_feature: GYAE6OF01DV7XV.29.20.B09.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (341)..(351): a, c, t, g, unknown or other
  misc_feature (341)..(351): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaaggcccatcgtctcccngcacctcncagncacctctggggcacagcggccctgggctgcctggtcaaggactacttccatctacactactgagcgggctggcaaggcgcagtacgnnnnnnnnnnn

SEQ ID NO: 266551 - DNA, 352 bp, Homo sapiens
  misc_feature: GYAE6OF01EGQF3.29.20.B09.1.454.CMB.1.raw
  modified_base (351)..(352): a, c, t, g, unknown or other
  misc_feature (351)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctcgtactgcgctgagcgggctggcaaggcgcatagnn

SEQ ID NO: 266552 - DNA, 358 bp, Homo sapiens
  misc_feature: GYAE6OF01C5998.29.20.B09.1.454.CMB.1.raw
  modified_base (353)..(358): a, c, t, g, unknown or other
  misc_feature (353)..(358): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacacgcggccctgggctgcctggtcaaggactacttcctcgtactgcgctgagcgggctggcaaggcgcatagnnnnnn

SEQ ID NO: 266553 - DNA, 219 bp, Homo sapiens
  misc_feature: GYAE6OF01BDCHB.29.20.B09.1.454.CMB.1.raw
  modified_base (215)..(219): a, c, t, g, unknown or other
  misc_feature (215)..(219): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnnnn

SEQ ID NO: 266554 - DNA, 438 bp, Homo sapiens
  misc_feature: GYAE6OF01DWTA0.29.20.B09.1.454.CMB.1.raw
  modified_base (254)..(254): a, c, t, g, unknown or other
  misc_feature (254)..(254): n is a, c, g, or t
  modified_base (402)..(402): a, c, t, g, unknown or other
  misc_feature (402)..(402): n is a, c, g, or t
  modified_base (408)..(438): a, c, t, g, unknown or other
  misc_feature (408)..(438): n is a, c, g, or t
tcagatagagtactcacgaccggtgctcgatttagtgtagtgtgaagggccggttcaccatctccagagacaattcaacagcacgctgtatttcgcacatgaacaggcctgagagccgaggacacggccatatattattgtgcgaaacttccttttgactggttattatcccctagtgaccactggggccagggaaccctggtcaccgtctcctcacgcctccaccgaacgggcccagtccgtccttcccccgnggccaccctcctaccgaagacgccaaccttcgtcgggggtccaccgtaggcccgggtcccgtggggcttcggccgttcgggtaccaaagggtaccttaaccgttaccttataaccggatccgctggacggcgggtctggcgaagggcncatagnnnnnnnnnnnnnnnnnnnnnnnnnnnnnnn

SEQ ID NO: 266555 - DNA, 363 bp, Homo sapiens
  misc_feature: GYAE6OF01E3YA8.29.20.B09.1.454.CMB.1.raw
  modified_base (358)..(363): a, c, t, g, unknown or other
  misc_feature (358)..(363): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggccaccctcctccaagacgccacctcgtgggggccacagccggccctgggctgcttggtcaaggactacttcctatacgatcgctgagcgggctggcaaggcgcatagnnnnnn

SEQ ID NO: 266556 - DNA, 359 bp, Homo sapiens
  misc_feature: GYAE6OF01DMOSS.29.20.B09.1.454.CMB.1.raw
  modified_base (353)..(359): a, c, t, g, unknown or other
  misc_feature (353)..(359): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctcgtggggcacagcggccctgggctgcctggtcaaggactacgttcctataccgatcgctgagcgggctggcaaggcgcatagnnnnnnn

SEQ ID NO: 266557 - DNA, 363 bp, Homo sapiens
  misc_feature: GYAE6OF01DAA8C.29.20.B09.1.454.CMB.1.raw
  modified_base (353)..(363): a, c, t, g, unknown or other
  misc_feature (353)..(363): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagacgcacctcgtgggggcacagcggccctgggctgcctggtcaaggactactcatagcgtactctgagcggctgggcaaggcgcagtagnnnnnnnnnnn

SEQ ID NO: 266558 - DNA, 357 bp, Homo sapiens
  misc_feature: GYAE6OF01EUX2G.29.20.B09.1.454.CMB.1.raw
  modified_base (351)..(357): a, c, t, g, unknown or other
  misc_feature (351)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactactccatacgcgtactctgagcgggctggcaaggcgcatagnnnnnnn

SEQ ID NO: 266559 - DNA, 216 bp, Homo sapiens
  misc_feature: GYAE6OF01EKFSR.29.20.B09.1.454.CMB.1.raw
  modified_base (215)..(216): a, c, t, g, unknown or other
  misc_feature (215)..(216): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnn

SEQ ID NO: 266560 - DNA, 380 bp, Homo sapiens
  misc_feature: GYAE6OF01CRTH8.29.20.B09.1.454.CMB.1.raw
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (363)..(380): a, c, t, g, unknown or other
  misc_feature (363)..(380): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggccaccctcctccaagacgcacctctgggggcacagcggccctggcgtgccgtggtcaaggacgtacttcctactacgatcgctgngcgggcgtggcaacggcgcacgtagngnnnnnnnnnnnnnnnnnn

SEQ ID NO: 266561 - DNA, 361 bp, Homo sapiens
  misc_feature: GYAE6OF01CW1YS.29.20.B09.1.454.CMB.1.raw
  modified_base (354)..(361): a, c, t, g, unknown or other
  misc_feature (354)..(361): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttcccctggccaccctcctccaagacgcacctcgtgggggcacagccggccctgggctgcctggtcaaggctaccttccatacgatcgctgacgcgggctggcaaggcgcatgnnnnnnnn

SEQ ID NO: 266562 - DNA, 217 bp, Homo sapiens; identical to SEQ ID NO: 266509
  misc_feature: GYAE6OF01BKXCH.29.20.B09.1.454.CMB.1.raw
  modified_base (215)..(217): a, c, t, g, unknown or other
  misc_feature (215)..(217): n is a, c, g, or t

SEQ ID NO: 266563 - DNA, 360 bp, Homo sapiens
  misc_feature: GYAE6OF01C7Z1D.29.20.B09.1.454.CMB.1.raw
  modified_base (349)..(360): a, c, t, g, unknown or other
  misc_feature (349)..(360): n is a, c, g, or t
tcagatagagtactcacgaccggtgctcgatttagtgtagtgtgaagggccggttcaccatctccagagacaattccaacagcacgctgtattgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagacgcacctctgggggcacagcggccctgggctgcctggtcaaggactacttccatacgatcgctgagcggctggcaaggcgcatagnnnnnnnnnnnn

SEQ ID NO: 266564 - DNA, 360 bp, Homo sapiens
  misc_feature: GYAE6OF01CV91P.29.20.B09.1.454.CMB.1.raw
  modified_base (264)..(264): a, c, t, g, unknown or other
  misc_feature (264)..(264): n is a, c, g, or t
  modified_base (350)..(360): a, c, t, g, unknown or other
  misc_feature (350)..(360): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttcccctggccaccctcctcaagngcacctctggggcacagcggccctgggctgcctggtcaaggactacttcctatacgatcgctgagcgggctggcaaggcgcatagnnnnnnnnnnn

SEQ ID NO: 266565 - DNA, 359 bp, Homo sapiens
  misc_feature: GYAE6OF01A1VBL.29.20.B09.1.454.CMB.1.raw
  modified_base (353)..(359): a, c, t, g, unknown or other
  misc_feature (353)..(359): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaccctggtcaccgtctcctcagcctccaccaagggcccatccggtcttccccctggccaccctcctccaagacgcacctctgggggcacagcggccctgggctgcctggtcaaggactacttccatagcgtactctgagcgggctggcaaggcgcatagnnnnnnn

SEQ ID NO: 266566 - DNA, 391 bp, Homo sapiens
  misc_feature: GYAE6OF01C3ZQE.29.20.B09.1.454.CMB.1.raw
  modified_base (361)..(391): a, c, t, g, unknown or other
  misc_feature (361)..(391): n is a, c, g, or t
tcagatagagtactcacgaccggtgctcgatttagtgtagtgtgaagggccggttcgaccatctccagagacaattccaacagcacgctgtatttgcacatgaacagcctgagagccgaggacacggccatatattattgtgcgaaacttccttttgactggttattatcccctagtgaccactggggccacggggaaccctgggtcaccgtctcctcagcctccaccaagggcccatcggtccttccccctggccaccctcctaccaagacgcacctctgggggcacagcggccctgggctgcctggcaaggactacttccatacgatcgctgaggcgggtctggcgaaggcgcagtagnnnnnnnnnnnnnnnnnnnnnnnnnnnnnnn

SEQ ID NO: 266567 - DNA, 362 bp, Homo sapiens
  misc_feature: GYAE6OF01CRY3T.29.20.B09.1.454.CMB.1.raw
  modified_base (353)..(362): a, c, t, g, unknown or other
  misc_feature (353)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggccaccctcctccaagagcacctctgggggcacagcggccctgggctgcctggtcaaggactacttcctcgtactgcgctgagcgggctggcaaggcgcatagnnnnnnnnnn

SEQ ID NO: 266568 - DNA, 355 bp, Homo sapiens
  misc_feature: GYAE6OF01EC4BC.29.20.B09.1.454.CMB.1.raw
  modified_base (352)..(355): a, c, t, g, unknown or other
  misc_feature (352)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctggggctgcctggtcaaggactacttcctatacgatcgctgagcgggctggcaaggcgcatagnnnn

SEQ ID NO: 266569 - DNA, 221 bp, Homo sapiens
  misc_feature: GYAE6OF01CRPTX.29.20.B09.1.454.CMB.1.raw
  modified_base (215)..(221): a, c, t, g, unknown or other
  misc_feature (215)..(221): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnnnnn

SEQ ID NO: 266570 - DNA, 361 bp, Homo sapiens
  misc_feature: GYAE6OF01B4E5Q.29.20.B09.1.454.CMB.1.raw
  modified_base (328)..(328): a, c, t, g, unknown or other
  misc_feature (328)..(328): n is a, c, g, or t
  modified_base (344)..(361): a, c, t, g, unknown or other
  misc_feature (344)..(361): n is a, c, g, or t
tcagatagagtactcacgaccggtgctcgatttagtgtagtgtgaagggccggttcaccatctccagagacaattccaacagcacgctgtatttgcacactgaacagcctgagagccgaggacacggccatatattattgtgcgaaacttccttttgactggttattatcccctagtgaccactgggccagggaaccctggtcaccgtctcctcagcctcaccaaggccatcggtcttcccctggcaccctctccaagagcacctctggggcacagcggccctgggctgcctggtcaaggactacgtctatacgatcgctgagcgggntggcaaggcgcatagnnnnnnnnnnnnnnnnnn

SEQ ID NO: 266571 - DNA, 366 bp, Homo sapiens
  misc_feature: GYAE6OF01CK6HF.29.20.B09.1.454.CMB.1.raw
  modified_base (348)..(348): a, c, t, g, unknown or other
  misc_feature (348)..(348): n is a, c, g, or t
  modified_base (355)..(366): a, c, t, g, unknown or other
  misc_feature (355)..(366): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctattgaccactggggccagggaaccctggtcaccgtctcctcagcctccaccaagggcccatcggtccttcccctggccaccctcctccaagacgcacctcgtggggcacagcggccctggctgcctggtcaaggactacctccctcgcgatatcgtgagcgggctggacaaggcncagtagnnnnnnnnnnnn

SEQ ID NO: 266572 - DNA, 216 bp, Homo sapiens; identical to SEQ ID NO: 266559
  misc_feature: GYAE6OF01EFHLM.29.20.B09.1.454.CMB.1.raw
  modified_base (215)..(216): a, c, t, g, unknown or other
  misc_feature (215)..(216): n is a, c, g, or t

SEQ ID NO: 266573 - DNA, 377 bp, Homo sapiens
  misc_feature: GYAE6OF01CKH61.29.20.B09.1.454.CMB.1.raw
  modified_base (269)..(269): a, c, t, g, unknown or other
  misc_feature (269)..(269): n is a, c, g, or t
  modified_base (365)..(377): a, c, t, g, unknown or other
  misc_feature (365)..(377): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtccaccgtctcctcagcctccaccaagggcccatccggtccttccccctggccaccctcctccagacncacctcgtcggggcacaggccggcccgtgggctcgccgtggtcaaggtacctacttcctcgtactgcgctggacgcgggctggcaaggcacatagnnnnnnnnnnnnn

SEQ ID NO: 266574 - DNA, 367 bp, Homo sapiens
  misc_feature: GYAE6OF01AL7YA.29.20.B09.1.454.CMB.1.raw
  modified_base (359)..(367): a, c, t, g, unknown or other
  misc_feature (359)..(367): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtctccccctggccacccctcctccaagacgccacctctggggggccacacgcggccctgggctgcctggtcaagggactacttcctatacgatcgctgagcgggctgggcaaggcgcatagnnnnnnnnn

SEQ ID NO: 266575 - DNA, 405 bp, Homo sapiens
  misc_feature: GYAE6OF01EBS9G.29.20.B09.1.454.CMB.1.raw
  modified_base (389)..(405): a, c, t, g, unknown or other
  misc_feature (389)..(405): n is a, c, g, or t
tcagatagagtactcacgaccggtgctcgatttagtgtagtgtgaagggccggttcaccatctccagagacaattccaacagcacgctgtatttgcaaatgaacagcctgagagccgaggacacggccacctatttctgtacgaaagaatacacacagctggacgaggagccaaacggcgactacttctttgactactgggccagggaaccctggtcaccgtctcctcacgcctccaccaagggccccatccggtccttcccccctggccacccctcctccaacgacgccaccctcgtcgggggccacaggccggcccctgggctggccctgggtacaagggactacttcctataccgatcgctgacgcgggctggcaaggcgcatagnnnnnnnnnnnnnnnnn

SEQ ID NO: 266576 - DNA, 219 bp, Homo sapiens
  misc_feature: GYAE6OF01A1DVF.29.20.B09.1.454.CMB.1.raw
  modified_base (215)..(219): a, c, t, g, unknown or other
  misc_feature (215)..(219): n is a, c, g, or t
tcagatagagtactcacgaccggtgctcgatttagtgtagtgtgaagggtgccagggaaccctggtcaccgtctcctcagcctccaccaaggcccatcggtcttccccctggcaccctcctccaagagcacctctgggggcacagcggccctgggctgcctggtcaaaggactacttcctctctcgactctgagcgggctggcaaggcgcatagnnnnn

SEQ ID NO: 266577 - DNA, 220 bp, Homo sapiens
  misc_feature: GYAE6OF01CPFAZ.29.20.B09.1.454.CMB.1.raw
  modified_base (215)..(220): a, c, t, g, unknown or other
  misc_feature (215)..(220): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnnnnn

SEQ ID NO: 266578 - DNA, 217 bp, Homo sapiens; identical to SEQ ID NO: 266509
  misc_feature: GYAE6OF01AW8QH.29.20.B09.1.454.CMB.1.raw
  modified_base (215)..(217): a, c, t, g, unknown or other
  misc_feature (215)..(217): n is a, c, g, or t

SEQ ID NO: 266579 - DNA, 362 bp, Homo sapiens
  misc_feature: GYAE6OF01D8P1Y.29.20.B09.1.454.CMB.1.raw
  modified_base (358)..(362): a, c, t, g, unknown or other
  misc_feature (358)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaacgggcccatccggtccttcccccctggccaccctcctccaagacgccacctctgggggcacgagcggccctgggctgcctggtcaaggactacttcctcgtactgcgctgagcggctggcaaggcgcatagnnnnn

SEQ ID NO: 266580 - DNA, 417 bp, Homo sapiens
  misc_feature: GYAE6OF01CSLVH.29.20.B09.1.454.CMB.1.raw
  modified_base (219)..(219): a, c, t, g, unknown or other
  misc_feature (219)..(219): n is a, c, g, or t
  modified_base (285)..(285): a, c, t, g, unknown or other
  misc_feature (285)..(285): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (366)..(366): a, c, t, g, unknown or other
  misc_feature (366)..(366): n is a, c, g, or t
  modified_base (381)..(381): a, c, t, g, unknown or other
  misc_feature (381)..(381): n is a, c, g, or t
  modified_base (384)..(386): a, c, t, g, unknown or other
  misc_feature (384)..(386): n is a, c, g, or t
  modified_base (388)..(417): a, c, t, g, unknown or other
  misc_feature (388)..(417): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattactcccctagtgaccacgtggggccaggggaaccctggtccaccgtctcctcncgccctccaaccgaaggggccctagtccggtccttcccccgtggcctacccctcctaccaaggacncaccctacgtgggggcacgtagcggcccgtgggcctgcctggtacaaggacctacttcctatacgntccgntgacgcgggntggacaaggcgacanagnnnannnnnnnnnnnnnnnnnnnnnnnnnnnnnn

SEQ ID NO: 266581 - DNA, 455 bp, Homo sapiens
  misc_feature: GYAE6OF01DUA90.29.20.B09.1.454.CMB.1.raw
  modified_base (430)..(431): a, c, t, g, unknown or other
  misc_feature (430)..(431): n is a, c, g, or t
  modified_base (433)..(455): a, c, t, g, unknown or other
  misc_feature (433)..(455): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgtaaactttccttttgacttggttattactcccctagtgaccacgtcggggccgacgggaccctggtccaccgtcctcctcacgccctccaaccgaacgggccccagtccggttcccttccccccgtggccctaccccttcctaccaagacgcctaccgtcggtcggggccacgacggccggcccgtgggctcgccgtcggtaccgaacggtaccttaccttcccgttcgtaccgtcggccgcgtcggacgggccgggcgtacgggaccgaacgggccgacgagtagnnannnnnnnnnnnnnnnnnnnnnnn

SEQ ID NO: 266582 - DNA, 218 bp, Homo sapiens
  misc_feature: GYAE6OF01BI8AZ.29.20.B09.1.454.CMB.1.raw
  modified_base (214)..(218): a, c, t, g, unknown or other
  misc_feature (214)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaggcgcatagnnnnn

SEQ ID NO: 266583 - DNA, 513 bp, Homo sapiens
  misc_feature: GYAE6OF01DJQD3.29.20.B09.1.454.CMB.1.raw
  modified_base (473)..(513): a, c, t, g, unknown or other
  misc_feature (473)..(513): n is a, c, g, or t
tcagatagagtactcacgaccggtgctcgatttagtgtagtgtgaagggccggttcaccatctccagagacaattccaacagcacgctgtatttgcaacatgaacagcctgagagccgaggacacggccatatattattgtgacgtaaacctttccttttgacttggttattactcccctagtcgaccacgtcggggaccgagggaaccccctgggtccacccgtcctcctcacgccctacccaccaacggggccctaacgtccggttccccttccccccgtcggcccaccccctcctacccgaagacgccacccgtcgtcggggggccaacgacggcccggaccccgtcggggtctcggcccgttgggtaccgtaacgggaaccctttaccttaccgaacgttacggtccggtaacctcgtagggacgggtaccgggtccgtaggggacctaaacgggcgacgtaaagtcgnnnnnnnnnnnnnnnnnnnnnnnnnnnnnnnnnnnnnnnnn

SEQ ID NO: 266584 - DNA, 218 bp, Homo sapiens
  misc_feature: GYAE6OF01BTHML.29.20.B09.1.454.CMB.1.raw
  modified_base (214)..(218): a, c, t, g, unknown or other
  misc_feature (214)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggctacttcctctctcgactctgagcgggctggcaaggcgcatagnnnnn

SEQ ID NO: 266585 - DNA, 385 bp, Homo sapiens
  misc_feature: GYAE6OF01ERPHZ.29.20.B09.1.454.CMB.1.raw
  modified_base (368)..(385): a, c, t, g, unknown or other
  misc_feature (368)..(385): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttccccctggccaccctcctccaagagccacctcgtgggggcacgagccggcccgtgggctcgccgtggtacaacggactacttccgcgtacgtagaccgtgaggcgggctggacgaaggcgcatagnnnnnnnnnnnnnnnnnn

SEQ ID NO: 266586 - DNA, 483 bp, Homo sapiens
  misc_feature: GYAE6OF01CYL7N.29.20.B09.1.454.CMB.1.raw
  modified_base (442)..(443): a, c, t, g, unknown or other
  misc_feature (442)..(443): n is a, c, g, or t
  modified_base (446)..(449): a, c, t, g, unknown or other
  misc_feature (446)..(449): n is a, c, g, or t
  modified_base (451)..(483): a, c, t, g, unknown or other
  misc_feature (451)..(483): n is a, c, g, or t
tcagatagagtactcacgaccggtgctcgatttagtgtagtgtgaagggccggttcaccatctccagagacaattccaacagcacgctgtatttgcacatgaacagcctgagagccgaggaccacggccatatattattgtgcgaaactttccttttgacttggttattactcccctagtcgaccacgtggggccaagggaaccctgggtcctaccgtcctcctcacgtccctacccaccgaacgggccctacgtccgggttcccttccccccgcggccctaccccctccctaccgaagacgccacccttcggtcgggggccaacgacggccggtcccgtggggcctcgccggtgtaccgaaggtaccttaccttcgactacctaaccgacctacgtggaccggccgggtcgtcgggacgaacgggacccgcaaagttcgcnngannnngnnnnnnnnnnnnnnnnnnnnnnnnnnnnnnnnn

SEQ ID NO: 266587 - DNA, 219 bp, Homo sapiens
  misc_feature: GYAE6OF01DZ7GF.29.20.B09.1.454.CMB.1.raw
  modified_base (216)..(219): a, c, t, g, unknown or other
  misc_feature (216)..(219): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctcgtgggggcacagcggccctgggctgcctggtcaaggactacttccatagcgtactctgagcgggctggcaaggcgcatagnnnn

SEQ ID NO: 266588 - DNA, 438 bp, Homo sapiens
  misc_feature: GYAE6OF01BT1WF.29.20.B09.1.454.CMB.1.raw
  modified_base (414)..(414): a, c, t, g, unknown or other
  misc_feature (414)..(414): n is a, c, g, or t
  modified_base (418)..(438): a, c, t, g, unknown or other
  misc_feature (418)..(438): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattactcccctagtgaccacgtggggccaggggaaccctggtccaccgtctcctcacgcctccacgaacgggcccagtccggtccttccccctggccaccctcctaccaaggacgccaccgtcgtcgggggcacgacggccggcccgtgggcctcgccgtaggtacgaacggtacctttaccgttcctaagtaccgacgttccggccttagggaacggccggggtctacgggacgaaacgggcgtacgaanaggnnnnnnnnnnnnnnnnnnnnn

SEQ ID NO: 266589 - DNA, 442 bp, Homo sapiens
  misc_feature: GYAE6OF01DPXI4.29.20.B09.1.454.CMB.1.raw
  modified_base (178)..(178): a, c, t, g, unknown or other
  misc_feature (178)..(178): n is a, c, g, or t
  modified_base (406)..(407): a, c, t, g, unknown or other
  misc_feature (406)..(407): n is a, c, g, or t
  modified_base (409)..(442): a, c, t, g, unknown or other
  misc_feature (409)..(442): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaactttccttttgactggttattatcccctagtnaccactggggccacgggacctggtcaccgtctcctcacgcctccaccgaacgggcccatccggtcccttcccccgtggcccacccctcctcccgaagacgcctacctcggtacgggggcaaccgaggccggcccgtggggcctcgcccgttgggtaccaaacggtaccttacctttacctactaccgatcggtcctggacggcgggctgggacgaacggcacagtagnntnnnnnnnnnnnnnnnnnnnnnnnnnnnnnnnnnn

SEQ ID NO: 266590 - DNA, 427 bp, Homo sapiens
  misc_feature: GYAE6OF01B5K59.29.20.B09.1.454.CMB.1.raw
  modified_base (404)..(427): a, c, t, g, unknown or other
  misc_feature (404)..(427): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgtaaacttccttttgactggttattactcccctagtgaccacgtggggccagggaaccctggtccaccgtctcctcagcctccaccaacgggcccatccggtccttcccccgtggccacccctcctccaagacgccaccctcggtcgggggaccacgacggccggcccgtgggcctggcccgtggtaccgaagggaccttaccttcctaactacgactccgcgtggacggcgggtcgtagggacgaaggcgacaagtacggnnnnnnnnnnnnnnnnnnnnnnnn

SEQ ID NO: 266591 - DNA, 411 bp, Homo sapiens
  misc_feature: GYAE6OF01APO7F.29.20.B09.1.454.CMB.1.raw
  modified_base (379)..(379): a, c, t, g, unknown or other
  misc_feature (379)..(379): n is a, c, g, or t
  modified_base (388)..(411): a, c, t, g, unknown or other
  misc_feature (388)..(411): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttccccccgtggccaccctcctccaagacgccacctcgtgggggtacacgccggcccgtggggcctcggcccgttgggtaccgaaaggtactacctttcctaataccggatcggctggaggcgggctgggcaagggccncgatacggnnnnnnnnnnnnnnnnnnnnnnnn

SEQ ID NO: 266592 - DNA, 355 bp, Homo sapiens
  misc_feature: GYAE6OF01CZ1W8.29.20.B09.1.454.CMB.1.raw
  modified_base (262)..(262): a, c, t, g, unknown or other
  misc_feature (262)..(262): n is a, c, g, or t
  modified_base (342)..(342): a, c, t, g, unknown or other
  misc_feature (342)..(342): n is a, c, g, or t
  modified_base (348)..(355): a, c, t, g, unknown or other
  misc_feature (348)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaaggcccatcggtcctcccctggcaccctcctccaagngcacctcgtgggggcacagcggccctgggctgcctggtcaaggctacttccatacgatcgctgagcgggctggcaaggcncatagnnnnnnnn

SEQ ID NO: 266593 - DNA, 517 bp, Homo sapiens
  misc_feature: GYAE6OF01BMU0X.29.20.B09.1.454.CMB.1.raw
  modified_base (474)..(474): a, c, t, g, unknown or other
  misc_feature (474)..(474): n is a, c, g, or t
  modified_base (476)..(517): a, c, t, g, unknown or other
  misc_feature (476)..(517): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgtaaacttccttttgactggttattactcccctagtcgaccacgtcggggccacgggaaccctggtccaccgtctcctcacgcctccaaccgaacgggcccctacgttccggtcccttccccccgtcggccctaccccctcccgtaccgaacggaccgtaccacccgttacggtcggggggaccaccggacggtcccggccccggtggggcctcggtcccggttacgggtacgaaaacggtcctttaaccttacccgtacggtacgacgtaccggtaccgtacgggacgggcggggtccggtagggaccgaagggcccgtatacggtagacngnnnnnnnnnnnnnnnnnnnnnnnnnnnnnnnnnnnnnnnnnn

SEQ ID NO: 266594 - DNA, 369 bp, Homo sapiens
  misc_feature: GYAE6OF01DVTR3.29.20.B09.1.454.CMB.1.raw
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (363)..(369): a, c, t, g, unknown or other
  misc_feature (363)..(369): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaaacttccttttgacttggttattactcccctagtgaccactggggccagggaaccctggtcaccgtctcctcagcctccaccaacgggcccatcggtccttccccctggccaccctcctccaagacgccacctcgtgggggcacgacgccggccctgggctcgcctggtcaaggactacttcctatacgntcgctggagcgggntggcaaggcnatgnnnnnnn

SEQ ID NO: 266595 - DNA, 504 bp, Homo sapiens
  misc_feature: GYAE6OF01AS3EK.29.20.B09.1.454.CMB.1.raw
  modified_base (471)..(504): a, c, t, g, unknown or other
  misc_feature (471)..(504): n is a, c, g, or t
tcagatagagtactcacgaccggtgctcgatttagtgtagtgtgaagggccggttcaccatctccagagacaattccaacagcacgctgtatttgcacatgaacagcctgagagccggaggaccacggaccaatattattattgtgacgtaaactttccttttgacttgttattactcccctagtcgaccacgtggggaccacggggaccctggtccaccgtcctcctcacgccctacccaaccgaaccgggcccattcccggttcccttccccccttcggccctaccccctcctaccaacgtacgcctacccgttccggtcgggggaccaccggaccggcccgggtccccggtcgggccgttacggtcccggttcggtacgaaaccgggttaaccttacccgtttaccgacgtaaccgtacggtcgtcgtacgggacgggtcgggcggtcggacgaacggcggacagtgnnnnnnnnnnnnnnnnnnnnnnnnnnnnnnnnnn

SEQ ID NO: 266596 - DNA, 754 bp, Homo sapiens
  misc_feature: GYAE6OF01CDGM3.29.20.B09.1.454.CMB.1.raw
  modified_base (136)..(136): a, c, t, g, unknown or other
  misc_feature (136)..(136): n is a, c, g, or t
tcagatagagtactcacgaccggtgctcgatttagtgtagtgtgaagggggctgtgggtccaggaggcagacctctgggtgtctcaccatggcctggatccctctaccttcctccccctcctcactctctgcacgnggctctgaggtccgcctatagaactgaacgacaggcccacccgtcgttggtcacggtcggtaccccccggacacggaccggtccatccatccaccgtgcctcgtaggagtattccgtccgttacggaaacgtaaaggtaaaatcgtacgtactaaggttggtactcgaagacgaagaacgaacgaccggaccgaccggttccccggtttggttttacggtctaagtttaacggttaaacgtaggtaacgtcggtacggtaccggtccctacggacggtaaccttcccgtagacgtccgttactcgtcggtccggtccgtccggtaccggtaccggacggaacccaacgaccgacccgtacccgtaccgaactactaacgtacggtccggtaccgtccggacggacgtaacggagggtaacggtacggccgtaggtaacccttagttacgttaacggttaacaacggtagaccgtacgttaccgaagtaccgtttacggtttaactttcgggtttaggttttcggaggtacggtagtacgagttccgtaccgtactacggtcgaccgcgtaccgtcccgtacccgtcccgtcgttactccctacctcggtcccctcccg

SEQ ID NO: 266597 - DNA, 301 bp, Homo sapiens
  misc_feature: GYAE6OF01C7IDY.29.20.B09.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (247)..(301): a, c, t, g, unknown or other
  misc_feature (247)..(301): n is a, c, g, or t
tcagatagagtactcacgaccggtgctcgatttagtgtagtgtgaagggtgccagggaaccctggtcaccgtctcctcagcctccaccaagggcccatcggtccttcccccctggccaccctcctccaagacgcacctcgtggggggcacgcgccggcccgtgggctcgccgtggtacgaagtacttaccttcctacgtacgccacttcgnggacgggccgggngtcggaccgacgggtcacagagnnnnnnnnnnnnnnnnnnnnnnnnnnnnnnnnnnnnnnnnnnnnnnnnnnnnnnn

SEQ ID NO: 266598 - DNA, 531 bp, Homo sapiens
  misc_feature: GYAE6OF01C1ZPU.29.20.B09.1.454.CMB.1.raw
  modified_base (477)..(478): a, c, t, g, unknown or other
  misc_feature (477)..(478): n is a, c, g, or t
  modified_base (480)..(480): a, c, t, g, unknown or other
  misc_feature (480)..(480): n is a, c, g, or t
  modified_base (483)..(486): a, c, t, g, unknown or other
  misc_feature (483)..(486): n is a, c, g, or t
  modified_base (488)..(531): a, c, t, g, unknown or other
  misc_feature (488)..(531): n is a, c, g, or t
tcagatagagtactcacgaccggtgctcgatttagtgtagtgtgaagggccggttcaccatctccagagacaattccaaacagcacgctgtatttgcacatgaacagcctgagagccggaggacacggccatatattattggtgacgtaaacctttccttttgacgttggtttaatttactcccctagtcgaccacggtcgggggaccacggggtaaccccttggtacctacccgtcctccctcgaccctcccgaccaaccggaaccggccttccggttcccgttacccccgtccccgtcgaccccttcccctcccgtaacgtaacgaccacctccggtcgggacggaccgcggccggcccggttcggcggtccgaccggtacggtcgtaaacgtacgtttaccctttacctaccgtaacgtacctcggtccggtggtacgggccgggtacgcgggtacgaacggcgcaagtagtanncngtnnnnannnnnnnnnnnnnnnnnnnnnnnnnnnnnnnnnnnnnnnnnnnn

SEQ ID NO: 266599 - DNA, 444 bp, Homo sapiens
  misc_feature: GYAE6OF01A2V1W.29.20.B09.1.454.CMB.1.raw
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (391)..(444): a, c, t, g, unknown or other
  misc_feature (391)..(444): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaaactttccttttgactggttattatcccctagtgaccacgtggggccaggggtaaccctggtccaccgtctcctcagcctccacgaaggcccatccggtcctccccctggccaccctcctcaaggcncncctcgtcgggggcacgagccggccctgggctggcctggtccaaggtactacttccatcgacgtctcgtggacgcggntgggacaagggcnctatacgnctanctnacgntcgnacgnnnnnnnnnnnnnnnnnnnnnnnnnnnnnnnnnnnnnnnnnnnnnnnnnnnnnn

SEQ ID NO: 266600 - DNA, 457 bp, Homo sapiens
  misc_feature: GYAE6OF01CJNEP.29.20.B09.1.454.CMB.1.raw
  modified_base (223)..(223): a, c, t, g, unknown or other
  misc_feature (223)..(223): n is a, c, g, or t
  modified_base (401)..(402): a, c, t, g, unknown or other
  misc_feature (401)..(402): n is a, c, g, or t
  modified_base (408)..(408): a, c, t, g, unknown or other
  misc_feature (408)..(408): n is a, c, g, or t
  modified_base (412)..(457): a, c, t, g, unknown or other
  misc_feature (412)..(457): n is a, c, g, or t
tcagatagagtactcacgaccggtgctcgatttagtgtagtgtgaagggccgggttcaccatcctccagagacaattccaacagcacgctgtatttgcacatgaacagcctgagagccgaggacacggccatatattattgtgcgaaacttccttttgactggttattactcccctagtcgaccacgtggggccaggggaacccctgggtccaccgtctcccncacgccctcccaaccaacgggccccagtccggtcctttcccccgggccaccctcctaccagagccacctcgtgggggccacgagccggcccgtgggcctcgcctgggtacaaggtccttaacttccagtacgatccgctagggcgcgggcgtggacgaaaggccgactaagtgcatgnngcaagncgannnnnnnnnnnnnnnnnnnnnnnnnnnnnnnnnnnnnnnnnnnnnn

SEQ ID NO: 266601 - DNA, 413 bp, Homo sapiens
  misc_feature: GYAE6OF01E0WWD.29.20.B09.1.454.CMB.1.raw
  modified_base (221)..(221): a, c, t, g, unknown or other
  misc_feature (221)..(221): n is a, c, g, or t
  modified_base (392)..(392): a, c, t, g, unknown or other
  misc_feature (392)..(392): n is a, c, g, or t
  modified_base (394)..(413): a, c, t, g, unknown or other
  misc_feature (394)..(413): n is a, c, g, or t
tcagatagagtactcacgaccggtgctcgatttagtgtagtgtgaagggccggttcaccatctccagagacaagttccaacagcacgctgtatttgcacatgaacagcctgagagccgaggacacggccatatattattgtgcgtaaactttccttttgacttggttattatcccctagtgaccacgtggggccagggaaccctggtcaccgtctcctcancctccacaacggccagtcggtccttcccccgtgccaccctcctccaacgacgccacctcgtcgggggcacacggccggcccgtgggcctcgccgtggtccgtaaggaccttaccttcccgtcgttaccgtggaccgtcgtggacggcggtcgtggctaacgggcacatagncnnnnnnnnnnnnnnnnnnnn

SEQ ID NO: 266602 - DNA, 453 bp, Homo sapiens
  misc_feature: GYAE6OF01E0EHI.29.20.B09.1.454.CMB.1.raw
  modified_base (423)..(453): a, c, t, g, unknown or other
  misc_feature (423)..(453): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatatttattgtgcgtaaactttccttttgacttggtttattactcccctagtgaccacgtgggggccagggaaccctggtccaccgtcctcctcacgcctccaaccgaacgggccccagtccggtcccttccccccgtggcccacccctccctaccaacgacgccacctcgtcgggggccacgacggccggcccgtgggctcgccgttcggtaccgaacggtaccttaccgttacctacgtacgacgtcggcgtcggacgggtccgggcgtcgggacgaacgggcacgaatgnnnnnnnnnnnnnnnnnnnnnnnnnnnnnnn

SEQ ID NO: 266603 - DNA, 244 bp, Homo sapiens
  misc_feature: GYAE6OF02G766B.29.20.B09.1.454.CMB.1.raw
  modified_base (210)..(244): a, c, t, g, unknown or other
  misc_feature (210)..(244): n is a, c, g, or t
tcagatagagtactcacgaccggtgctcgatttagtgtagtgtgaagggtggccgagggacctggtcaccgtctcctcagcctccacaaggccatcggtcttcccctggcaccctcctccaagagcacctctggggcacagcggccctgggctgcctggtcaaggactacttcctcgtagcactctgagcgggctggcaaggcgcatagnnnnnnnnnnnnnnnnnnnnnnnnnnnnnnnnnnn

SEQ ID NO: 266604 - DNA, 354 bp, Homo sapiens
  misc_feature: GYAE6OF02HFC4F.29.20.B09.1.454.CMB.1.raw
  modified_base (350)..(354): a, c, t, g, unknown or other
  misc_feature (350)..(354): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctccaagagcacctctgggggcacagcggccctgggctgcctggtcaaggactacttccatagcgtactctgagcgggctggcaaggcgcatagnnnnn

SEQ ID NO: 266605 - DNA, 224 bp, Homo sapiens
  misc_feature: GYAE6OF02GR6JY.29.20.B09.1.454.CMB.1.raw
  modified_base (214)..(224): a, c, t, g, unknown or other
  misc_feature (214)..(224): n is a, c, g, or t
tcagatagagtactcacgaccggtgctcgatttagtgtagtgtgaagggtgccagggaaccctggtcaccgtcgtcctcagcctccaccaagggcccatcggtcttcccctggcgccctgctccaggagcacctccgagagcacagcggccctgggctgcctggtcaaggctacttccatagcgtactctgagcgggctggcaaggcgcatagnnnnnnnnnnn

SEQ ID NO: 266606 - DNA, 221 bp, Homo sapiens
  misc_feature: GYAE6OF02IHGLG.29.20.B09.1.454.CMB.1.raw
  modified_base (213)..(221): a, c, t, g, unknown or other
  misc_feature (213)..(221): n is a, c, g, or t
tcagatagagtactcacgaccggtgctcgatttagtgtagtgtgagggtgccagggaccctggtcaccgtctcctcagcctccaccaagggcccatcggtcttcccctggcaccctcctccaagagcacctctgggggcacagcggccctgggctgcctggtcaaggactacttcctctctcgactctgagcgggctggcaaggcgccatagnnnnnnnnn

SEQ ID NO: 266607 - DNA, 302 bp, Homo sapiens
  misc_feature: GYAE6OF02FN0UA.29.20.B09.1.454.CMB.1.raw
  modified_base (236)..(302): a, c, t, g, unknown or other
  misc_feature (236)..(302): n is a, c, g, or t
tcagatagagtactcacgaccggtgctcgatttagtgtagtgtgaagggtaggccagggaacctggtcaccgtctcctcagcctccaccaagggcccaatcggtcttccccctaggcaccctcctccgtaagagccacctcctgggggcacagcggccctgggctggccctggtccaagggactacgttcctctctcggactcgtcgaggcgggctgggcaaggtcgcagtacgcnnnnnnnnnnnnnnnnnnnnnnnnnnnnnnnnnnnnnnnnnnnnnnnnnnnnnnnnnnnnnnnnnnn

SEQ ID NO: 266608 - DNA, 214 bp, Homo sapiens; identical to SEQ ID NO: 266483
  misc_feature: GYAE6OF02IT8KU.29.20.B09.1.454.CMB.1.raw
  modified_base (214)..(214): a, c, t, g, unknown or other
  misc_feature (214)..(214): n is a, c, g, or t

SEQ ID NO: 266609 - DNA, 216 bp, Homo sapiens
  misc_feature: GYAE6OF02JB07R.29.20.B09.1.454.CMB.1.raw
  modified_base (214)..(216): a, c, t, g, unknown or other
  misc_feature (214)..(216): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccatagcgtactctgagcgggctggcaaggcgcatagnnn

SEQ ID NO: 266610 - DNA, 214 bp, Homo sapiens
  misc_feature: GYAE6OF02IU0IK.29.20.B09.1.454.CMB.1.raw
  modified_base (213)..(214): a, c, t, g, unknown or other
  misc_feature (213)..(214): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttccatagcgtactctgagcgggctggcaaggcgcatagnn

SEQ ID NO: 266611 - DNA, 215 bp, Homo sapiens; identical to SEQ ID NO: 266536
  misc_feature: GYAE6OF02JBO4K.29.20.B09.1.454.CMB.1.raw
  modified_base (214)..(215): a, c, t, g, unknown or other
  misc_feature (214)..(215): n is a, c, g, or t

SEQ ID NO: 266612 - DNA, 355 bp, Homo sapiens
  misc_feature: GYAE6OF02FY78N.29.20.B09.1.454.CMB.1.raw
  modified_base (348)..(355): a, c, t, g, unknown or other
  misc_feature (348)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctccgtcagcctccaccaagggcccatcggtcttccccctggcaccctcctccaagagcacctctgggggcacagcggcctgggctgcctggtcaaggctacttcctatacatcgctgagcggctggcaaggcgcatagnnnnnnnn

SEQ ID NO: 266613 - DNA, 356 bp, Homo sapiens
  misc_feature: GYAE6OF02HWTSO.29.20.B09.1.454.CMB.1.raw
  modified_base (351)..(356): a, c, t, g, unknown or other
  misc_feature (351)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttcctcgtactgcgctgagcgggctggcaaggcgcatagnnnnnn

SEQ ID NO: 266614 - DNA, 214 bp, Homo sapiens
  misc_feature: GYAE6OF02HE9X6.29.20.B09.1.454.CMB.1.raw
  modified_base (213)..(214): a, c, t, g, unknown or other
  misc_feature (213)..(214): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttcctctctcgactctgagcgggctggcaaggcgcatagnn

SEQ ID NO: 266615 - DNA, 357 bp, Homo sapiens
  misc_feature: GYAE6OF02I6HI4.29.20.B09.1.454.CMB.1.raw
  modified_base (351)..(357): a, c, t, g, unknown or other
  misc_feature (351)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnnnnn

SEQ ID NO: 266616 - DNA, 355 bp, Homo sapiens; identical to SEQ ID NO: 266524
  misc_feature: GYAE6OF02F8Q6A.29.20.B09.1.454.CMB.1.raw
  modified_base (351)..(355): a, c, t, g, unknown or other
  misc_feature (351)..(355): n is a, c, g, or t

SEQ ID NO: 266617 - DNA, 214 bp, Homo sapiens
  misc_feature: GYAE6OF02FPCIZ.29.20.B09.1.454.CMB.1.raw
  modified_base (214)..(214): a, c, t, g, unknown or other
  misc_feature (214)..(214): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttcctctctcgactctgagcgggctggcaaggcgcatagn

SEQ ID NO: 266618 - DNA, 215 bp, Homo sapiens
  misc_feature: GYAE6OF02HKPIX.29.20.B09.1.454.CMB.1.raw
  modified_base (213)..(215): a, c, t, g, unknown or other
  misc_feature (213)..(215): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttcctctctcgactctgagcgggctggcaaggcgcatagnnn

SEQ ID NO: 266619 - DNA, 352 bp, Homo sapiens
  misc_feature: GYAE6OF02HGZRP.29.20.B09.1.454.CMB.1.raw
  modified_base (350)..(352): a, c, t, g, unknown or other
  misc_feature (350)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctccaagagcacctctgggggcacagcggccctgggctgcctggtcaaggactacttcctatacgatcgctgagcgggctggcaaggcgcatagnnn

SEQ ID NO: 266620 - DNA, 358 bp, Homo sapiens
  misc_feature: GYAE6OF02F7MJ6.29.20.B09.1.454.CMB.1.raw
  modified_base (352)..(358): a, c, t, g, unknown or other
  misc_feature (352)..(358): n is a, c, g, or t
tcagatagagtactcacgaccggtgctcgatttagtgtagtgtgaagggccggttcaccatctccagagacaattccaacagcatgctgtatttgcacatgaacagcctgagagccgaggacacggccatatattattgtgcgaaacttccttttgactggttattatcccctagtgaccactggggccagggaaccctggtcgaccgtctcctcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnn

SEQ ID NO: 266621 - DNA, 292 bp, Homo sapiens
  misc_feature: GYAE6OF02HI0K8.29.20.B09.1.454.CMB.1.raw
  modified_base (289)..(292): a, c, t, g, unknown or other
  misc_feature (289)..(292): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccgccatctgatatgtatactctgagcgggctggcaaggcgcatagnnnn

SEQ ID NO: 266622 - DNA, 159 bp, Homo sapiens
  misc_feature: GYAE6OF02IZ8VM.29.20.B09.1.454.CMB.1.raw
  modified_base (159)..(159): a, c, t, g, unknown or other
  misc_feature (159)..(159): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctcatgtcctactgctgagcgggctggcaaggcgcatagn

SEQ ID NO: 266623 - DNA, 364 bp, Homo sapiens
  misc_feature: GYAE6OF02HBML1.29.20.B09.1.454.CMB.1.raw
  modified_base (353)..(364): a, c, t, g, unknown or other
  misc_feature (353)..(364): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattggtgcgaaacttccttttgactggttattatcccctagtgaccactggggccagggaaccctggtcaccgtctcctcagcctccaccaagggcccatcggtcttccccctggcaccctcctccaacgagcacctctgggggcacagcggccctgggctgcctggtcaaggactacttcctatacgatcgctgagcgggctggcaaggcgcatagnnnnnnnnnnnn

SEQ ID NO: 266624 - DNA, 215 bp, Homo sapiens; identical to SEQ ID NO: 266536
  misc_feature: GYAE6OF02IGRB2.29.20.B09.1.454.CMB.1.raw
  modified_base (214)..(215): a, c, t, g, unknown or other
  misc_feature (214)..(215): n is a, c, g, or t

SEQ ID NO: 266625 - DNA, 356 bp, Homo sapiens; identical to SEQ ID NO: 266613
  misc_feature: GYAE6OF02FVX57.29.20.B09.1.454.CMB.1.raw
  modified_base (351)..(356): a, c, t, g, unknown or other
  misc_feature (351)..(356): n is a, c, g, or t

SEQ ID NO: 266626 - DNA, 222 bp, Homo sapiens
  misc_feature: GYAE6OF02FO935.29.20.B09.1.454.CMB.1.raw
  modified_base (214)..(222): a, c, t, g, unknown or other
  misc_feature (214)..(222): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttcctctctcgactctgagcgggctggcaaggcgcatagnnnnnnnnn

SEQ ID NO: 266627 - DNA, 356 bp, Homo sapiens
  misc_feature: GYAE6OF02IH35Y.29.20.B09.1.454.CMB.1.raw
  modified_base (351)..(356): a, c, t, g, unknown or other
  misc_feature (351)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctcaaagagcacctctgggggcacagcggccctgggctgcctggtcaaggctacttccagacgtatcactgagcgggctggcaaggcgcatagnnnnnn

SEQ ID NO: 266628 - DNA, 356 bp, Homo sapiens
  misc_feature: GYAE6OF02G9GXV.29.20.B09.1.454.CMB.1.raw
  modified_base (350)..(356): a, c, t, g, unknown or other
  misc_feature (350)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctggactgcctggtcaaggctacttcctatacgatcgctgagcgggctggcaaggcgcatagnnnnnnn

SEQ ID NO: 266629 - DNA, 387 bp, Homo sapiens
  misc_feature: GYAE6OF02G8EVP.29.20.B09.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (359)..(387): a, c, t, g, unknown or other
  misc_feature (359)..(387): n is a, c, g, or t
tcagatagagtactcacgaccggtgctcgatttagtgtagtgtgaagggtccgggtttcgaccatctccagagacaacttccaacagcacgctcgtatttgcacatgaacagcctgagagccgaggacacggccatatattattgtgcgaaacttccttttgactggttattatcccctagtgaccactggggcctagggaacccgtggtcaccgtctcctcagcctccaccaagggcccatcggtcttccccctggcaccctcctccaagancacctcngggggcacagcggcctggctgcctggtcaaggctacgttccatagcgtacctctgagcgggctggcaaggcgcataggnnnnnnnnnnnnnnnnnnnnnnnnnnnnn

SEQ ID NO: 266630 - DNA, 356 bp, Homo sapiens; identical to SEQ ID NO: 266492
  misc_feature: GYAE6OF02FLRHE.29.20.B09.1.454.CMB.1.raw
  modified_base (351)..(356): a, c, t, g, unknown or other
  misc_feature (351)..(356): n is a, c, g, or t

SEQ ID NO: 266631 - DNA, 216 bp, Homo sapiens
  misc_feature: GYAE6OF02F94R1.29.20.B09.1.454.CMB.1.raw
  modified_base (215)..(216): a, c, t, g, unknown or other
  misc_feature (215)..(216): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnn

SEQ ID NO: 266632 - DNA, 357 bp, Homo sapiens
  misc_feature: GYAE6OF02IW8XI.29.20.B09.1.454.CMB.1.raw
  modified_base (345)..(345): a, c, t, g, unknown or other
  misc_feature (345)..(345): n is a, c, g, or t
  modified_base (351)..(357): a, c, t, g, unknown or other
  misc_feature (351)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggcaccctcctccaagagcacctctgggggcacagcggccctgggctgcctggtcaaggactacttcctatacgatcgctgagcgggctggcaagggcncatagnnnnnnn

SEQ ID NO: 266633 - DNA, 355 bp, Homo sapiens
  misc_feature: GYAE6OF02I9QXP.29.20.B09.1.454.CMB.1.raw
  modified_base (352)..(355): a, c, t, g, unknown or other
  misc_feature (352)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttccatagcgtactctgagcgggctggcaaggcgcatagnnnn

SEQ ID NO: 266634 - DNA, 216 bp, Homo sapiens
  misc_feature: GYAE6OF02JFKMO.29.20.B09.1.454.CMB.1.raw
  modified_base (213)..(216): a, c, t, g, unknown or other
  misc_feature (213)..(216): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttccagtactctatctgagcgggctggcaaggcgcatagnnnn

SEQ ID NO: 266635 - DNA, 365 bp, Homo sapiens
  misc_feature: GYAE6OF02GQQA6.29.20.B09.1.454.CMB.1.raw
  modified_base (289)..(289): a, c, t, g, unknown or other
  misc_feature (289)..(289): n is a, c, g, or t
  modified_base (352)..(365): a, c, t, g, unknown or other
  misc_feature (352)..(365): n is a, c, g, or t
tcagatagagtactcacgaccggtgctcgatttagtgtagtgtgaagggccggttcgaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctcgtggggcacagccgccngggctgcctggtcaaggactacttcctcgtactgcgctgagcgggctggcaaggcgcagtagnnnnnnnnnnnnnn

SEQ ID NO: 266636 - DNA, 218 bp, Homo sapiens
  misc_feature: GYAE6OF02I2L65.29.20.B09.1.454.CMB.1.raw
  modified_base (213)..(218): a, c, t, g, unknown or other
  misc_feature (213)..(218): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttcccgagcgacgactgagcgggctggcaaggcgcatagnnnnnn

SEQ ID NO: 266637 - DNA, 225 bp, Homo sapiens
  misc_feature: GYAE6OF02GN1UN.29.20.B09.1.454.CMB.1.raw
  modified_base (219)..(225): a, c, t, g, unknown or other
  misc_feature (219)..(225): n is a, c, g, or t
tcagatagagtactcacgaccggtgctcgatttagtgtagtgtgaagggtgccagggaaccctggtcaccgtctcctcagcctccaccgaacgggcccatcggtccttcccctggccaccctcctccaagagcacctcgtgggggcacagcggccctgggctgcctggtcaaggactacttcctctctcgactctgagcgggctggcaaggcgcatagnnnnnnn

SEQ ID NO: 266638 - DNA, 242 bp, Homo sapiens
  misc_feature: GYAE6OF02GPR6F.29.20.B09.1.454.CMB.1.raw
  modified_base (215)..(242): a, c, t, g, unknown or other
  misc_feature (215)..(242): n is a, c, g, or t
tcagatagagtactcacgaccggtgctcgatttagtgtagtgtgaagggtgccgagggaaccctggtcaccgtctcctcagcctccaccaaggcccatcggtcttccccgtggcaccctcctccaagacgcacctctgggggcacagcggcctgggctgcctggtcaaggctacttccatagcgtactctgagcgggctggcaaggcgcataggnnnnnnnnnnnnnnnnnnnnnnnnnnnn

SEQ ID NO: 266639 - DNA, 356 bp, Homo sapiens
  misc_feature: GYAE6OF02FIDS2.29.20.B09.1.454.CMB.1.raw
  modified_base (350)..(356): a, c, t, g, unknown or other
  misc_feature (350)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctggggcacagcggccctgggctgcctggtcaaggactacttccatagcgtactctgagcgggctggcaaggcgcatagnnnnnnn

SEQ ID NO: 266640 - DNA, 353 bp, Homo sapiens
  misc_feature: GYAE6OF02FSRHU.29.20.B09.1.454.CMB.1.raw
  modified_base (351)..(353): a, c, t, g, unknown or other
  misc_feature (351)..(353): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccgtactagacgctgagcgggctggcaaggcgcatagnnn

SEQ ID NO: 266641 - DNA, 389 bp, Homo sapiens
  misc_feature: GYAE6OF02GDZXF.29.20.B09.1.454.CMB.1.raw
  modified_base (359)..(389): a, c, t, g, unknown or other
  misc_feature (359)..(389): n is a, c, g, or t
tcagatagagtactcacgaccggtgctcgatttagtgtagtgtgaagggccggggttcaccatctccagagacaattccaacagcacgctgtatttgcacatgaacagcctgagagcccgaggaccacggcccactatattaattgtgcgaaacttccttttgactggttattatcccctagtgaccactgggccagggaaccctggtcaccgtctcctcacgcctcaccaaggcccatcgtcttcccctgcaccctcctccaagagcacctctgggggtcacagcggccctgggcctgcctggtcaaggactacgttccctatatactgtctgagcggactggcaaggccgcagtagnnnnnnnnnnnnnnnnnnnnnnnnnnnnnnn

SEQ ID NO: 266642 - DNA, 215 bp, Homo sapiens
  misc_feature: GYAE6OF02HMOY3.29.20.B09.1.454.CMB.1.raw
  modified_base (215)..(215): a, c, t, g, unknown or other
  misc_feature (215)..(215): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagn

SEQ ID NO: 266643 - DNA, 215 bp, Homo sapiens
  misc_feature: GYAE6OF02I8SX0.29.20.B09.1.454.CMB.1.raw
  modified_base (214)..(215): a, c, t, g, unknown or other
  misc_feature (214)..(215): n is a, c, g, or t
tcagatagagtactcacgaccggtgctcgatttagtgtagtgtgaagggtgcccgggaaccctggtcaccgtctcctcagcctccaccaagggcccatcggtcttccccctggcaccctcctccaagagcacctctggggcacagcggccctgggctgcctggtcaaggactacttcctctctcgactctgagcgggctggcaaggcgcatagnn

SEQ ID NO: 266644 - DNA, 216 bp, Homo sapiens; identical to SEQ ID NO: 266609
  misc_feature: GYAE6OF02F6IBO.29.20.B09.1.454.CMB.1.raw
  modified_base (214)..(216): a, c, t, g, unknown or other
  misc_feature (214)..(216): n is a, c, g, or t

SEQ ID NO: 266645 - DNA, 355 bp, Homo sapiens
  misc_feature: GYAE6OF02I2CEE.29.20.B09.1.454.CMB.1.raw
  modified_base (348)..(355): a, c, t, g, unknown or other
  misc_feature (348)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccacaagggcccatcggtcttccccctggcaccctcctccaagcgcacctctggggcacagcggcctgggctgcctggtcaaggactacttcctataccgatcgctgagcgggctggcaggcgcatagnnnnnnnn

SEQ ID NO: 266646 - DNA, 504 bp, Homo sapiens
  misc_feature: GYAE6OF02HK846.29.20.B09.1.454.CMB.1.raw
  modified_base (232)..(232): a, c, t, g, unknown or other
  misc_feature (232)..(232): n is a, c, g, or t
  modified_base (234)..(235): a, c, t, g, unknown or other
  misc_feature (234)..(235): n is a, c, g, or t
  modified_base (237)..(237): a, c, t, g, unknown or other
  misc_feature (237)..(237): n is a, c, g, or t
  modified_base (252)..(253): a, c, t, g, unknown or other
  misc_feature (252)..(253): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (272)..(272): a, c, t, g, unknown or other
  misc_feature (272)..(272): n is a, c, g, or t
  modified_base (274)..(275): a, c, t, g, unknown or other
  misc_feature (274)..(275): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (286)..(287): a, c, t, g, unknown or other
  misc_feature (286)..(287): n is a, c, g, or t
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (315)..(316): a, c, t, g, unknown or other
  misc_feature (315)..(316): n is a, c, g, or t
  modified_base (318)..(318): a, c, t, g, unknown or other
  misc_feature (318)..(318): n is a, c, g, or t
  modified_base (322)..(323): a, c, t, g, unknown or other
  misc_feature (322)..(323): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (337)..(337): a, c, t, g, unknown or other
  misc_feature (337)..(337): n is a, c, g, or t
  modified_base (460)..(460): a, c, t, g, unknown or other
  misc_feature (460)..(460): n is a, c, g, or t
tcagatagagtactcacgaccggtgctcgatttagtgtagtgtgaagggtggcctagggggaacccttggtcacggtctcctcagcctccaccaagggtccccatctcgtcgttcccctggcacctcctccaagagccactctcggggcacagcggcctgggctgctgggtcaaggactactccagtatagttctcgtgagcgggctggctaagggcgtttcgacttaggtngnngnctgcaacgccatccnntcttngnctatnangngcncnncgngtcngcgnngtgtcgtgcactctcnctcncncactcnncncgcnncncgcgngntatcnctactatctcacacatacttactttctctacttagttcgtacgacgtacgagcgtagagtacgtacgaacgtacgtacgtcgtcgcgacgactctctcgtctctctctctctactcgtacgtntactactacgtacgtcgtgacggcggcgacgacgtacgcgtacg

SEQ ID NO: 266647 - DNA, 269 bp, Homo sapiens
  misc_feature: GYAE6OF02IQDF4.29.20.B09.1.454.CMB.1.raw
  modified_base (223)..(269): a, c, t, g, unknown or other
  misc_feature (223)..(269): n is a, c, g, or t
tcagatagagtactcacgaccggtgctcgattttagtgtagtgtgaagggtgccgagggaaccctggtcaccgtctcctcagcctccaccaagggcccatcggtcttcccctggccaccctcctccaagagcgaccttctgggggcacacgcggccctgggcctggcctggtacaaggactacttccatagcgtactctgagcgggctggcaaggcgcatagnnnnnnnnnnnnnnnnnnnnnnnnnnnnnnnnnnnnnnnnnnnnnnn

SEQ ID NO: 266648 - DNA, 356 bp, Homo sapiens; identical to SEQ ID NO: 266492
  misc_feature: GYAE6OF02G5HIQ.29.20.B09.1.454.CMB.1.raw
  modified_base (351)..(356): a, c, t, g, unknown or other
  misc_feature (351)..(356): n is a, c, g, or t

SEQ ID NO: 266649 - DNA, 362 bp, Homo sapiens
  misc_feature: GYAE6OF02IW3UF.29.20.B09.1.454.CMB.1.raw
  modified_base (262)..(262): a, c, t, g, unknown or other
  misc_feature (262)..(262): n is a, c, g, or t
  modified_base (344)..(344): a, c, t, g, unknown or other
  misc_feature (344)..(344): n is a, c, g, or t
  modified_base (349)..(362): a, c, t, g, unknown or other
  misc_feature (349)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtctcccctggcatcctcctccaagngcacctctgggggcacagcggccctgggctgcctggtcaaggactacttcctatacgatcgctgagcgggctggcaaggcgnatagnnnnnnnnnnnnnn

SEQ ID NO: 266650 - DNA, 363 bp, Homo sapiens
  misc_feature: GYAE6OF02JQ91D.29.20.B09.1.454.CMB.1.raw
  modified_base (354)..(363): a, c, t, g, unknown or other
  misc_feature (354)..(363): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagacgccacctctgggggcacagcggccctgggctgcctggtcaaggactacttcctatacgatccgctgagcgggctggcaggcgcatagnnnnnnnnnn

SEQ ID NO: 266651 - DNA, 355 bp, Homo sapiens
  misc_feature: GYAE6OF02G83GM.29.20.B09.1.454.CMB.1.raw
  modified_base (350)..(355): a, c, t, g, unknown or other
  misc_feature (350)..(355): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggcctgggctgcctggtcaaggactacttcctatacgatcgctgagcgggctggcaaggcgcatagnnnnnn

SEQ ID NO: 266652 - DNA, 357 bp, Homo sapiens; identical to SEQ ID NO: 266499
  misc_feature: GYAE6OF02HELP4.29.20.B09.1.454.CMB.1.raw
  modified_base (351)..(357): a, c, t, g, unknown or other
  misc_feature (351)..(357): n is a, c, g, or t

SEQ ID NO: 266653 - DNA, 217 bp, Homo sapiens
  misc_feature: GYAE6OF02GC298.29.20.B09.1.454.CMB.1.raw
  modified_base (215)..(217): a, c, t, g, unknown or other
  misc_feature (215)..(217): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnn

SEQ ID NO: 266654 - DNA, 356 bp, Homo sapiens
  misc_feature: GYAE6OF02FM7VO.29.20.B09.1.454.CMB.1.raw
  modified_base (351)..(356): a, c, t, g, unknown or other
  misc_feature (351)..(356): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnnnnn

SEQ ID NO: 266655 - DNA, 386 bp, Homo sapiens
  misc_feature: GYAE6OF02HTIST.29.20.B09.1.454.CMB.1.raw
  modified_base (367)..(386): a, c, t, g, unknown or other
  misc_feature (367)..(386): n is a, c, g, or t
tcagatagagtactcacgaccggtgctcgatttagtgtagtgtgaagggccggttcgaccatctccagagacaattccaacagcacgctgtatttgcgaccatgaacagcctggagagccgaggacacggccatatacttattgtgcgaaacttccttttgactggttattatcccctagtgaccactgggccagggaaccctggtcaccgtctcctcagcctccaccaacgggcccatcggtccttccccccgtggccacccctcctccaagagccacctcgtgggggcacagcggccctgggctgcctggtccaaggcctacttccatagcgtactctgagcgggctggcgaaggccgcataggnnnnnnnnnnnnnnnnnnnn

SEQ ID NO: 266656 - DNA, 350 bp, Homo sapiens
  misc_feature: GYAE6OF02HZXDY.29.20.B09.1.454.CMB.1.raw
  modified_base (347)..(350): a, c, t, g, unknown or other
  misc_feature (347)..(350): n is a, c, g, or t
tcagatagagtactcacgaccggtgctcgatttagtgtagtgtgaagggccggttcaccatctccagagacaattccaacagcacgctgtatttgcacatgaacagcctgagagcccgaggacacggccatatattattgtgcgaaacttccttttgactggttattatcccctagtgaccactgggccagggaaccctggtcaccgtctcctcagcctccacaaggcccatcgtcttccccctggcaccctcctccaagagcacctcgtggggcacgagcggcctgggctgcctggtcaaggactacttcctatacgatcgctgagcggctggcaaggcgcatagnnnn

SEQ ID NO: 266657 - DNA, 214 bp, Homo sapiens
  misc_feature: GYAE6OF02I5SBA.29.20.B09.1.454.CMB.1.raw
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatag

SEQ ID NO: 266658 - DNA, 367 bp, Homo sapiens
  misc_feature: GYAE6OF02JVXK6.29.20.B09.1.454.CMB.1.raw
  modified_base (355)..(367): a, c, t, g, unknown or other
  misc_feature (355)..(367): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttcccctggccaccctcctccaagacgcacctctgggggcacgagcggccctgggctgcctggtcaaggactacttccctatacgatcgctgagcgggctggcaaggcgcatacgnnnnnnnnnnnnn

SEQ ID NO: 266659 - DNA, 352 bp, Homo sapiens
  misc_feature: GYAE6OF02GEDIO.29.20.B09.1.454.CMB.1.raw
  modified_base (350)..(352): a, c, t, g, unknown or other
  misc_feature (350)..(352): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttcctatacgatcgctgagcgggctggcaaggcgcatagnnn

SEQ ID NO: 266660 - DNA, 361 bp, Homo sapiens
  misc_feature: GYAE6OF02GW9PE.29.20.B09.1.454.CMB.1.raw
  modified_base (354)..(361): a, c, t, g, unknown or other
  misc_feature (354)..(361): n is a, c, g, or t
tcagatagagtactcacgaccggtgctcgatttagtgtagtgtgaagggccggttcaccatctccagggacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggcacccctcctccaagagcacctctgggggcacagcggccctgggctgccctggtcaaggactacttcctatacgatcgctgagcgggctggcaaggcgcatagnnnnnnnn

SEQ ID NO: 266661 - DNA, 357 bp, Homo sapiens
  misc_feature: GYAE6OF02H1FTR.29.20.B09.1.454.CMB.1.raw
  modified_base (351)..(357): a, c, t, g, unknown or other
  misc_feature (351)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttcctatacgatcgctgagcgggctggcaggcgcatagnnnnnnn

SEQ ID NO: 266662 - DNA, 358 bp, Homo sapiens
  misc_feature: GYAE6OF02H9OHB.29.20.B09.1.454.CMB.1.raw
  modified_base (352)..(358): a, c, t, g, unknown or other
  misc_feature (352)..(358): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttcctatacgatcgctgagcgggctggcaaggcgcatagnnnnnnn

SEQ ID NO: 266663 - DNA, 353 bp, Homo sapiens
  misc_feature: GYAE6OF02F95S5.29.20.B09.1.454.CMB.1.raw
  modified_base (351)..(353): a, c, t, g, unknown or other
  misc_feature (351)..(353): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnn

SEQ ID NO: 266664 - DNA, 217 bp, Homo sapiens
  misc_feature: GYAE6OF02IS2AN.29.20.B09.1.454.CMB.1.raw
  modified_base (214)..(217): a, c, t, g, unknown or other
  misc_feature (214)..(217): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctgggggcacagcggccctgggctgcctggtcaaggactacttccatagcgtactctgagcgggctggcaaggcgcatagnnnn

SEQ ID NO: 266665 - DNA, 353 bp, Homo sapiens; identical to SEQ ID NO: 266663
  misc_feature: GYAE6OF02F6MK5.29.20.B09.1.454.CMB.1.raw
  modified_base (351)..(353): a, c, t, g, unknown or other
  misc_feature (351)..(353): n is a, c, g, or t

SEQ ID NO: 266666 - DNA, 219 bp, Homo sapiens; identical to SEQ ID NO: 266553
  misc_feature: GYAE6OF02I3GE9.29.20.B09.1.454.CMB.1.raw
  modified_base (215)..(219): a, c, t, g, unknown or other
  misc_feature (215)..(219): n is a, c, g, or t

SEQ ID NO: 266667 - DNA, 357 bp, Homo sapiens
  misc_feature: GYAE6OF02FUE6D.29.20.B09.1.454.CMB.1.raw
  modified_base (352)..(357): a, c, t, g, unknown or other
  misc_feature (352)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagcgcacctctgggggcacagcggccctgggctgcctggtcaaggactacttccatagcgtactctgagcgggctggcaaggcgcatagnnnnnn

SEQ ID NO: 266668 - DNA, 219 bp, Homo sapiens
  misc_feature: GYAE6OF02GRCRC.29.20.B09.1.454.CMB.1.raw
  modified_base (215)..(219): a, c, t, g, unknown or other
  misc_feature (215)..(219): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnnnnn

SEQ ID NO: 266669 - DNA, 374 bp, Homo sapiens
  misc_feature: GYAE6OF02I658J.29.20.B09.1.454.CMB.1.raw
  modified_base (265)..(265): a, c, t, g, unknown or other
  misc_feature (265)..(265): n is a, c, g, or t
  modified_base (356)..(374): a, c, t, g, unknown or other
  misc_feature (356)..(374): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtccaccgtctcctaagcctcaccaagggcccatcggtcttccccctggccaccctcctccaagnccacctctgggggccacagcggccctgggctgcctggtcaaggactacttcctatacgatcgctgagcgggactggcaaggcgcactagcnnnnnnnnnnnnnnnnnnn

SEQ ID NO: 266670 - DNA, 361 bp, Homo sapiens
  misc_feature: GYAE6OF02HA8D9.29.20.B09.1.454.CMB.1.raw
  modified_base (352)..(361): a, c, t, g, unknown or other
  misc_feature (352)..(361): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggacatatattattgtgcgaaacttccttttgactggttattatcccctagtgaccactggggccagggaaccctggtcaccgtctcctcagcctccaccaagggcccatcggtctccccctggccaccctcctccaagagcacctcgtggggcacagccggccgtgggctgcctggtcaaggctacttcctcgtactgcgctgagcgggctggcaaggcgcagtagnnnnnnnnnn

SEQ ID NO: 266671 - DNA, 220 bp, Homo sapiens
  misc_feature: GYAE6OF02F2HIB.29.20.B09.1.454.CMB.1.raw
  modified_base (215)..(220): a, c, t, g, unknown or other
  misc_feature (215)..(220): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccagtactctatctgagcgggctggcaaggcgcatagnnnnnn

SEQ ID NO: 266672 - DNA, 390 bp, Homo sapiens
  misc_feature: GYAE6OF02GMFHQ.29.20.B09.1.454.CMB.1.raw
  modified_base (213)..(213): a, c, t, g, unknown or other
  misc_feature (213)..(213): n is a, c, g, or t
  modified_base (355)..(390): a, c, t, g, unknown or other
  misc_feature (355)..(390): n is a, c, g, or t
tcagatagagtactcacgaccggtgctcgatttagtgtagtgtgaagggtccgggttcgaccatctcccagagacaattccaacagcacgctgtatttgcacatgaacagcctgagagccgaggacacggccatatattattgtgcgaaacttccttttgactggttattatcccctagtgaccactggggccagggaaccctggtcaccgtntcctcagcctccaccaaggcccatcggtcttccccctggcaccctcctccaagagcacctctgggggcacagtcggccctgggctgcctggtcaaggactacttccatacgatcgctgagcggctggcaaggcgcagtacgnnnnnnnnnnnnnnnnnnnnnnnnnnnnnnnnnnnn

SEQ ID NO: 266673 - DNA, 360 bp, Homo sapiens
  misc_feature: GYAE6OF02FXTLQ.29.20.B09.1.454.CMB.1.raw
  modified_base (353)..(360): a, c, t, g, unknown or other
  misc_feature (353)..(360): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagacgcacctctgggggcacagcggccctgggctgcctggtcaaggactacttcctatacgatcgctgagcgggctggcaaggcgcatagnnnnnnnn

SEQ ID NO: 266674 - DNA, 436 bp, Homo sapiens
  misc_feature: GYAE6OF02JIXI4.29.20.B09.1.454.CMB.1.raw
  modified_base (251)..(251): a, c, t, g, unknown or other
  misc_feature (251)..(251): n is a, c, g, or t
  modified_base (400)..(436): a, c, t, g, unknown or other
  misc_feature (400)..(436): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccacgtggggccagggaaccctggtcaccgtctcctcagcctccaccaacgggcccatccggtccttcccccncgcgaccctccctccacgacgcacctctcggggcgacacgccggccgtccggcgcgtccgtcggtcgaacggaacgtaccttacctactacgaacgtcgtccgtgtacggccgggccgttgggacgaacgggacgccgtagtaagtggnnnnnnnnnnnnnnnnnnnnnnnnnnnnnnnnnnnnn

SEQ ID NO: 266675 - DNA, 218 bp, Homo sapiens
  misc_feature: GYAE6OF02G2I4Z.29.20.B09.1.454.CMB.1.raw
  modified_base (215)..(218): a, c, t, g, unknown or other
  misc_feature (215)..(218): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttccatagcgtactctgagcgggctggcaaggcgcatagnnnn

SEQ ID NO: 266676 - DNA, 357 bp, Homo sapiens
  misc_feature: GYAE6OF02G7YIA.29.20.B09.1.454.CMB.1.raw
  modified_base (350)..(357): a, c, t, g, unknown or other
  misc_feature (350)..(357): n is a, c, g, or t
tcagatagagtactcacgaccggtgctcgatttagtgtagtgtgaagggccggttcaccatctccagagacaattccaacagcacgctgtatttgcacatgaacagccctgagagccgaggacacggccatatattattgtgcgaaacttccttttgactggttattatcccctagtgaccactggggccagggaaccctggtcaccgtctcctcagcctccaccaagggcccatcggtcttccccctgcgccctgctccaggagcacctccgagagcacagcggcccctgggctgcctggtcaaggctactccacgtgatcgactgagcgggctggcaaggcgcatagnnnnnnnn

SEQ ID NO: 266677 - DNA, 550 bp, Homo sapiens
  misc_feature: GYAE6OF02H0DHS.29.20.B09.1.454.CMB.1.raw
  modified_base (227)..(227): a, c, t, g, unknown or other
  misc_feature (227)..(227): n is a, c, g, or t
  modified_base (229)..(231): a, c, t, g, unknown or other
  misc_feature (229)..(231): n is a, c, g, or t
  modified_base (234)..(234): a, c, t, g, unknown or other
  misc_feature (234)..(234): n is a, c, g, or t
  modified_base (236)..(238): a, c, t, g, unknown or other
  misc_feature (236)..(238): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (259)..(260): a, c, t, g, unknown or other
  misc_feature (259)..(260): n is a, c, g, or t
  modified_base (262)..(263): a, c, t, g, unknown or other
  misc_feature (262)..(263): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (290)..(290): a, c, t, g, unknown or other
  misc_feature (290)..(290): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
tcagatagagtactcacgaccggtgctcgatttagtgtagtgtgaagggtggccgaggggaccctggtccaccgtctaccgtcagcctccaccgaagggcccatcggtcgttccccctggccaccctcctccaaggacgctacctctgggggctacagcggccctgggctgcctggtcaaggctacttcatagcgtactctgagcgggctggcaaggcgcagtacgnannncgncnnngngcngnatcanagatatatnntnngntagagngcgcgngcactctgtgacntctacgntntatcgagctgtgcacgtagtcgtatcgagacgcgtacgtagtacgacgacgacgtactacgtacgtactacgacgtacgtacgacgacgacgtacgacgtacgtacgtagtagtacgtacgtacgtacgtacgtacgtagtacgacgtagtagtagtacgtagtcgttcggtacggtacgtacgtacgtagtacggtacgtacgtacgtacgacgtacgtacgtacgtcgtccgtacgtcgtacgtcgtcg

SEQ ID NO: 266678 - DNA, 219 bp, Homo sapiens
  misc_feature: GYAE6OF02IPTH6.29.20.B09.1.454.CMB.1.raw
  modified_base (215)..(219): a, c, t, g, unknown or other
  misc_feature (215)..(219): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcgggctggcaaggcgcatagnnnnn

SEQ ID NO: 266679 - DNA, 440 bp, Homo sapiens
  misc_feature: GYAE6OF02GZIXF.29.20.B09.1.454.CMB.1.raw
  modified_base (282)..(282): a, c, t, g, unknown or other
  misc_feature (282)..(282): n is a, c, g, or t
  modified_base (365)..(365): a, c, t, g, unknown or other
  misc_feature (365)..(365): n is a, c, g, or t
  modified_base (371)..(372): a, c, t, g, unknown or other
  misc_feature (371)..(372): n is a, c, g, or t
  modified_base (374)..(376): a, c, t, g, unknown or other
  misc_feature (374)..(376): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (388)..(440): a, c, t, g, unknown or other
  misc_feature (388)..(440): n is a, c, g, or t
tcagatagagtactcacgaccggtgctcgattttagtgtagtgtgaagggccgggttcaccatctccagagaccaattccaacagcaacgcctgtatttgcacatgtaacagccctgagagccgaggaccacggccactatattattagtgcgaaacttccttttgactggttattatcccctagtcgaccactggggccagggaaccctgggtcaccgtcctccctcagcctccaccgaagggccccatcggtcttccccctggccaccctcctccaagcnccacctcgtcggggcacagccggccctgggcctggccctggtcaaggctacttcatagcgtactctgagcggctggcaaggcncatagnngnnngnctgcangtcnnnnnnnnnnnnnnnnnnnnnnnnnnnnnnnnnnnnnnnnnnnnnnnnnnnnn

SEQ ID NO: 266680 - DNA, 357 bp, Homo sapiens
  misc_feature: GYAE6OF02I9DYW.29.20.B09.1.454.CMB.1.raw
  modified_base (350)..(357): a, c, t, g, unknown or other
  misc_feature (350)..(357): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagagcacctctgggggcacagcggccctgggctgcctggtcaaggctacttccatagcgtactctgagcgggctggcaaggcgcatagnnnnnnnn

SEQ ID NO: 266681 - DNA, 282 bp, Homo sapiens
  misc_feature: GYAE6OF02GCKNR.29.20.B09.1.454.CMB.1.raw
  modified_base (221)..(221): a, c, t, g, unknown or other
  misc_feature (221)..(221): n is a, c, g, or t
  modified_base (225)..(282): a, c, t, g, unknown or other
  misc_feature (225)..(282): n is a, c, g, or t
tcagatagagtactcacgaccggtgctcgatttagtgtagtgtgaagggtgccagggaaccctggtcacccgtctccttcagccttccaccaagggcccatcggtcttccccctggcaccctctccaagagccacctctgggggcacagcggccctgggccttgcctggtcaaggtactacttccatagcgtactctgagcgggctggcaaggcgcatagngcgnnnnnnnnnnnnnnnnnnnnnnnnnnnnnnnnnnnnnnnnnnnnnnnnnnnnnnnnnn

SEQ ID NO: 266682 - DNA, 420 bp, Homo sapiens
  misc_feature: GYAE6OF02I3VIV.29.20.B09.1.454.CMB.1.raw
  modified_base (245)..(245): a, c, t, g, unknown or other
  misc_feature (245)..(245): n is a, c, g, or t
  modified_base (365)..(365): a, c, t, g, unknown or other
  misc_feature (365)..(365): n is a, c, g, or t
  modified_base (368)..(369): a, c, t, g, unknown or other
  misc_feature (368)..(369): n is a, c, g, or t
  modified_base (371)..(371): a, c, t, g, unknown or other
  misc_feature (371)..(371): n is a, c, g, or t
  modified_base (374)..(376): a, c, t, g, unknown or other
  misc_feature (374)..(376): n is a, c, g, or t
  modified_base (378)..(420): a, c, t, g, unknown or other
  misc_feature (378)..(420): n is a, c, g, or t
tcagatagagtactcacgaccggtgctcgatttagtgtagtgtgaagggccggttcgaccatctccagagacaattccaacagcacgctgtatttgcacatgaacagcctgagagccgaggacacggccatatattattggtgcgaaacttcttttgactggttattatcccctagtgaccactggggcagggaccctggtcaccgtctctcagcctccacaacggcccatcggtccttccccgnggccacccctcctccaagcgccacctcgtgggggcacagcggtccctggggctgccgtggtcaaggtacctaccgttccacggtgactccggactggaggcgggcgtggcaaggcgacanagnnanatnnncnnnnnnnnnnnnnnnnnnnnnnnnnnnnnnnnnnnnnnnnnnn

SEQ ID NO: 266683 - DNA, 388 bp, Homo sapiens
  misc_feature: GYAE6OF02I5EU1.29.20.B09.1.454.CMB.1.raw
  modified_base (365)..(365): a, c, t, g, unknown or other
  misc_feature (365)..(365): n is a, c, g, or t
  modified_base (369)..(388): a, c, t, g, unknown or other
  misc_feature (369)..(388): n is a, c, g, or t
tcagatagagtactcacgaccggtgctcgatttagtgtagtgtgaagggccgggttcaccatctccagagacaattccaacagcacgctgtattgcacatgaacagcctgagagccgaggacacggccatatattattgtgcgaaacttcctttgactggttatatcccctagtgaccactggggccagggaaccctggtcaccgtctcctcagcctccaccaagggcccatcggtccttcccctggccaccctcctccaagcgccacctctgggggcacacgtcgggccctggggctgccctggtcgaaggaccttaacttcctatacgtactcggctggacgcgggcgtggcaaaggcgacanaggnnnnnnnnnnnnnnnnnnnn

SEQ ID NO: 266684 - DNA, 359 bp, Homo sapiens
  misc_feature: GYAE6OF02HW0RR.29.20.B09.1.454.CMB.1.raw
  modified_base (352)..(359): a, c, t, g, unknown or other
  misc_feature (352)..(359): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggccaccctcctccaagagcacctctgggggcacagcggccctgggctgcctggtcaaggactacttcctatacgatcgctgagcgggctggcaaggcgcatagnnnnnnnn

SEQ ID NO: 266685 - DNA, 217 bp, Homo sapiens
  misc_feature: GYAE6OF02FGK9J.29.20.B09.1.454.CMB.1.raw
  modified_base (213)..(217): a, c, t, g, unknown or other
  misc_feature (213)..(217): n is a, c, g, or t
tcagatagagtactcacgaccggtgctcgatttagtgtagtgtgaagggtgccagggaaccctggtcaccgtctcctcagcctccaccaagggcccatcggtcttcccctggcaccctcctccaagagcacctctggggcacagcggccctgggctgcctggtcaaggactacttcctctctcgactctgagcgggctggcaaggcgcatagnnnnn

SEQ ID NO: 266686 - DNA, 358 bp, Homo sapiens
  misc_feature: GYAE6OF02HE1EL.29.20.B09.1.454.CMB.1.raw
  modified_base (352)..(358): a, c, t, g, unknown or other
  misc_feature (352)..(358): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatccctagtgaccactggggccagggaaccctggtcaccgtctcctcagcctccacaagggcccatcggtcttccccctggccaccctcctccaagagccacctctgggggcacagcggccctgggctgcctggtcaaggactacttcctatacgatcgctgagcgggctggcaaggcgcagtagnnnnnnn

SEQ ID NO: 266687 - DNA, 362 bp, Homo sapiens
  misc_feature: GYAE6OF02I5VCT.29.20.B09.1.454.CMB.1.raw
  modified_base (331)..(331): a, c, t, g, unknown or other
  misc_feature (331)..(331): n is a, c, g, or t
  modified_base (353)..(362): a, c, t, g, unknown or other
  misc_feature (353)..(362): n is a, c, g, or t
tcagatagagtactcacgaccggtgctcgatttagtgtagtgtgaagggccggttcaccatctccagagacaattccaacagcacgctgtatttgcacatgaacagcctgagagccgaggacaggccatatattattgtgcgaaacttcctttgactggttattatcccctagtgaccactggggccagggaaccctggtcaccgtctcctcagcctccaccaagggcccatcggtcttccccctggcaccctcctccaagacgcacctctcgggggcacagcggccctgggctgcctggtcaaggactacttcctatacgtcgcctggancgggctggcaaggcgtcatagnnnnnnnnnn

SEQ ID NO: 266688 - DNA, 397 bp, Homo sapiens
  misc_feature: GYAE6OF02HM29T.29.20.B09.1.454.CMB.1.raw
  modified_base (286)..(286): a, c, t, g, unknown or other
  misc_feature (286)..(286): n is a, c, g, or t
  modified_base (363)..(363): a, c, t, g, unknown or other
  misc_feature (363)..(363): n is a, c, g, or t
  modified_base (369)..(397): a, c, t, g, unknown or other
  misc_feature (369)..(397): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactgggccagggaaccctggtcaccgtctcctcagcctccaccaagggcccatcggtcttccccctggccaccctcctcaagacgccacctcgtcgggggcaacgnggccggcccgtgggctcgccgtggacaaggactaccttaccgacgtagactacgacgtgacgcggctggacacggcncatagnnnnnnnnnnnnnnnnnnnnnnnnnnnnn

SEQ ID NO: 266689 - DNA, 363 bp, Homo sapiens
  misc_feature: GYAE6OF02HG8W3.29.20.B09.1.454.CMB.1.raw
  modified_base (328)..(328): a, c, t, g, unknown or other
  misc_feature (328)..(328): n is a, c, g, or t
  modified_base (356)..(363): a, c, t, g, unknown or other
  misc_feature (356)..(363): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggccacccctcctccaagagccacctcgtgggggccacagcggccctgggctgcctggtcaaggactacttcctatacgntcgctgagcgggctggcaggcacatagnnnnnnnn

SEQ ID NO: 266690 - DNA, 363 bp, Homo sapiens
  misc_feature: GYAE6OF02GTY3W.29.20.B09.1.454.CMB.1.raw
  modified_base (356)..(363): a, c, t, g, unknown or other
  misc_feature (356)..(363): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcacgcctccaccaagggcccatccggtccttccccctggccacccctcctccaagcgccacctcgtgggggcacagccggccctgggctgcctggtcaaggctacttcctatacgatcgctgagcggctggcaggcgcatagnnnnnnnn

SEQ ID NO: 266691 - DNA, 374 bp, Homo sapiens
  misc_feature: GYAE6OF02FMFF2.29.20.B09.1.454.CMB.1.raw
  modified_base (289)..(289): a, c, t, g, unknown or other
  misc_feature (289)..(289): n is a, c, g, or t
  modified_base (351)..(374): a, c, t, g, unknown or other
  misc_feature (351)..(374): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggcaccctcctccaagagcacctctgggggcacagcgcccngggctgctggtcaaggctactctatacgatcgctgaggcggctggcaaggtcgacatagcannnnnnnnnnnnnnnnnnnnnnnn

SEQ ID NO: 266692 - DNA, 461 bp, Homo sapiens
  misc_feature: GYAE6OF02GSZ2V.29.20.B09.1.454.CMB.1.raw
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (401)..(406): a, c, t, g, unknown or other
  misc_feature (401)..(406): n is a, c, g, or t
  modified_base (408)..(461): a, c, t, g, unknown or other
  misc_feature (408)..(461): n is a, c, g, or t
tcagatagagtactcacgaccggtgctcgatttagtgtagtgtgaagggccgggttcaccatctccagagacaattccaacagcacgctgtatttgcacatgaacagcctgagagccgaggacacggccatatattattgtgcgaaacttccttttgactggttattatccctagtgaccactggggcagggaccctggtcaccgtntccnagcctccaccgaagggcccagtcggtccttccccctggccacccctcctaccgaaagacgacacctctggggggccacgaaggccggcccttagggctgcccgtggttcaaacggactaacttccctaattacgactcggcttgaacgcggggatcggtcaaacggcggtacaagttaaggcatcacgtnnnnnnannnnnnnnnnnnnnnnnnnnnnnnnnnnnnnnnnnnnnnnnnnnnnnnnnnnnn

SEQ ID NO: 266693 - DNA, 221 bp, Homo sapiens
  misc_feature: GYAE6OF02G67BT.29.20.B09.1.454.CMB.1.raw
  modified_base (216)..(221): a, c, t, g, unknown or other
  misc_feature (216)..(221): n is a, c, g, or t
tcagatagagtactcacgaccggtgctcgatttagtgtagtgtgaagggtgccagggaaccctggtcaccgtctcctcagcctccaccaagggcccatcggtcttccccctggccaccctcctccaagagcacctctgggggcacagcggccctgggctgcctggtcaaggactacttcctctctcgactctgagcgggctggcaaggcgcatagnnnnnn

SEQ ID NO: 266694 - DNA, 365 bp, Homo sapiens
  misc_feature: GYAE6OF02G0QTF.29.20.B09.1.454.CMB.1.raw
  modified_base (352)..(352): a, c, t, g, unknown or other
  misc_feature (352)..(352): n is a, c, g, or t
  modified_base (358)..(365): a, c, t, g, unknown or other
  misc_feature (358)..(365): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatccggtcttccccctggccgccctgcctccgaggacgccacctccgagacgcacagcggccctgggctgcctggtcaaggactacttccatagcgtactctgagcgggctggcaaggcncatagnnnnnnnn

SEQ ID NO: 266695 - DNA, 237 bp, Homo sapiens
  misc_feature: GYAE6OF02HE8MQ.29.20.B09.1.454.CMB.1.raw
  modified_base (214)..(237): a, c, t, g, unknown or other
  misc_feature (214)..(237): n is a, c, g, or t
tcagatagagtactcacgaccggtgctcgatttagtgtagtgtgaagggtgccagggaaccctggtcaccgtctcctcagcctccaccaagggcccatcggtcttccccctggcaccctcctccaagagcacctctgggggcacagcggccctgggctgcctggtcaaggactacttcctctctcgactctgagcggctggcaaggcgcatagnnnnnnnnnnnnnnnnnnnnnnnn

SEQ ID NO: 266696 - DNA, 365 bp, Homo sapiens
  misc_feature: GYAE6OF02IOO9U.29.20.B09.1.454.CMB.1.raw
  modified_base (256)..(256): a, c, t, g, unknown or other
  misc_feature (256)..(256): n is a, c, g, or t
  modified_base (342)..(365): a, c, t, g, unknown or other
  misc_feature (342)..(365): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatccctagtgaccactgggccagggaaccctggtcaccgtctcctcagcctcacaagggccatcgtcttcccctgcaccctcctcaagancacctctgggggcaacagcggcctggctgcctggcaaggcctacttccatagccgtactctgaggcggctggacaaggcgcatagnnnnnnnnnnnnnnnnnnnnnnnn

SEQ ID NO: 266697 - DNA, 438 bp, Homo sapiens
  misc_feature: GYAE6OF02JJ00N.29.20.B09.1.454.CMB.1.raw
  modified_base (132)..(132): a, c, t, g, unknown or other
  misc_feature (132)..(132): n is a, c, g, or t
  modified_base (385)..(385): a, c, t, g, unknown or other
  misc_feature (385)..(385): n is a, c, g, or t
  modified_base (387)..(388): a, c, t, g, unknown or other
  misc_feature (387)..(388): n is a, c, g, or t
  modified_base (391)..(393): a, c, t, g, unknown or other
  misc_feature (391)..(393): n is a, c, g, or t
  modified_base (395)..(438): a, c, t, g, unknown or other
  misc_feature (395)..(438): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatanattattgtgcgaaacttccttttgactggttattatcccctagtgaccactggggccagggaaccctggtcaccgtctcctcgacgcctccaccgaacgggccccagtcggtccttccccccgtggccacccctccctaccaagacgccacctcgcgggggcaccgagccggcccgtgggcctgccgtggtccgaaggacctaccttcctatacgactcgctgaggccgggtcgcggcgaggccgacagtagnanngcnnngnnnnnnnnnnnnnnnnnnnnnnnnnnnnnnnnnnnnnnnnnnnn

SEQ ID NO: 266698 - DNA, 426 bp, Homo sapiens
  misc_feature: GYAE6OF02IOS53.29.20.B09.1.454.CMB.1.raw
  modified_base (282)..(282): a, c, t, g, unknown or other
  misc_feature (282)..(282): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (373)..(426): a, c, t, g, unknown or other
  misc_feature (373)..(426): n is a, c, g, or t
tcagatagagtactcacgaccggtgctcgatttagtgtagtgtgaagggccgggttcacccatctccagagacaattccaacagcacgctgtatttgcacatgaacagcctgagagccgaggacacggcccatatattattgtgcgaaacttccttttgactggttattatcccctagtgaccactggggccagggaaccctggtcaccgtctcctcagcctccaccaagggcccatcggtcttccccctggcacccctctccaagagcacctctgggggcncagccggccctgggctgcctggtacaaggactacttcctatacgatccgctaggacgcgggactgggacaaggcgaccatacgnangnacnnnnnnnnnnnnnnnnnnnnnnnnnnnnnnnnnnnnnnnnnnnnnnnnnnnnnn

SEQ ID NO: 266699 - DNA, 494 bp, Homo sapiens
  misc_feature: GYAE6OF02G9DZX.29.20.B09.1.454.CMB.1.raw
  modified_base (133)..(133): a, c, t, g, unknown or other
  misc_feature (133)..(133): n is a, c, g, or t
  modified_base (460)..(460): a, c, t, g, unknown or other
  misc_feature (460)..(460): n is a, c, g, or t
  modified_base (465)..(494): a, c, t, g, unknown or other
  misc_feature (465)..(494): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatnttatgtgcgtaaactttccttttgacttggttattactcccctagttaccacgtcggggccacgggaaccctggtccaccgtctccctcgacgccctacccaccggaacgggcccctagttcccgggttcccttcccccgtacgggcccctaacccctcccgtacccaaggaacgcccgtacgtccggtggggggcaccgacggccgggtcccgtcggggactcggtacccgttggtaccgaaacggtaccttaccgttccctaagttaccgagttacccgcgtgggaacgggtccggggcgtacgggacgaaacgggccgtcgaanaggcnnnnnnnnnnnnnnnnnnnnnnnnnnnnnn

SEQ ID NO: 266700 - DNA, 375 bp, Homo sapiens
  misc_feature: GYAE6OF02FT06S.29.20.B09.1.454.CMB.1.raw
  modified_base (361)..(361): a, c, t, g, unknown or other
  misc_feature (361)..(361): n is a, c, g, or t
  modified_base (363)..(375): a, c, t, g, unknown or other
  misc_feature (363)..(375): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagccctccaccaacgggcccatcggtccttccccctggccaccctcctccaagacgcacctctcgggggcacagcggccctgggctgcctggtcaaggactacttccagtagcgtactcgtgagcgggctggccgaaggccgcatancnnnnnnnnnnnnn

SEQ ID NO: 266701 - DNA, 461 bp, Homo sapiens
  misc_feature: GYAE6OF02IGHE1.29.20.B09.1.454.CMB.1.raw
  modified_base (257)..(257): a, c, t, g, unknown or other
  misc_feature (257)..(257): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (425)..(461): a, c, t, g, unknown or other
  misc_feature (425)..(461): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggcatatattatgtgcgaaacttccttttgactggttattactcccctagtgaccactggggccacgggaaccctgggtccaccgtctcctcgagccctccaaccgaaggggccccatccggtccttccccgnggacccaccccttccctccgaacgagcccacccgtcgtcgggggccacgacggccggccccgtggcgtccgccgtggccgaaaggtcctaccttccagttacgcgttacctgtcggaggtccggacgtcggacaaggggccgcctagtaacggnacgtgnacgtcatnnnnnnnnnnnnnnnnnnnnnnnnnnnnnnnnnnnnn

SEQ ID NO: 266702 - DNA, 453 bp, Homo sapiens
  misc_feature: GYAE6OF02F9R5G.29.20.B09.1.454.CMB.1.raw
  modified_base (366)..(366): a, c, t, g, unknown or other
  misc_feature (366)..(366): n is a, c, g, or t
  modified_base (392)..(392): a, c, t, g, unknown or other
  misc_feature (392)..(392): n is a, c, g, or t
  modified_base (395)..(396): a, c, t, g, unknown or other
  misc_feature (395)..(396): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (409)..(453): a, c, t, g, unknown or other
  misc_feature (409)..(453): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttcctttttgacttggttattatcccctagtgaccactggggccagggaaccctggtccaccgtctcctcacgcctccacccgaacgggcccctatccggttccttcccccccgtggcccaccccctcctaccaagacgcaccctcgtcgggggcacgacgccgggccctggggctgcctgggtcaaggtaccttaccgttcctcgtactgcgctaggngcgggctggacgaaggccgcagtagngcnncnagcntagntgnnnnnnnnnnnnnnnnnnnnnnnnnnnnnnnnnnnnnnnnnnnnn

SEQ ID NO: 266703 - DNA, 416 bp, Homo sapiens
  misc_feature: GYAE6OF02FSMSA.29.20.B09.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (385)..(416): a, c, t, g, unknown or other
  misc_feature (385)..(416): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcacgcctccaccaagggcccatcgtctccccngccaccctccnccaagcgcacctcgtggggcacaggccggccccgtgggctgccgtggtacgaacggtaccttacttacccgagtacgccgtaacctcgtcggacggccgggtcgtgggacgaagggcgacgtagtacgnnnnnnnnnnnnnnnnnnnnnnnnnnnnnnnn

SEQ ID NO: 266704 - DNA, 392 bp, Homo sapiens
  misc_feature: GYAE6OF02FPGWL.29.20.B09.1.454.CMB.1.raw
  modified_base (363)..(367): a, c, t, g, unknown or other
  misc_feature (363)..(367): n is a, c, g, or t
  modified_base (369)..(392): a, c, t, g, unknown or other
  misc_feature (369)..(392): n is a, c, g, or t
tcagatagagtactcacgaccggtgctcgatttagtgtagtgtgaagggccggttcaccatctccagagacaattccaacagcacgctgtatttgcacatgaacagccctgagagcccgagggacacggccatatattattgtgcgaaacttccctttttgactggttattatcccctagtgaccactggggccagggaaccctggtcaccgtctcctcacgcctccaccaagggcccatccggtctcccccgtggccaccctcctccaagacgcacctcgtgggggcacagcggccctgggctgcctggtcaagggtactacttccatagcgtactctgagcgggctggcaaggcgcagtannnnncnnnnnnnnnnnnnnnnnnnnnnnn

SEQ ID NO: 266705 - DNA, 358 bp, Homo sapiens
  misc_feature: GYAE6OF02FH6TC.29.20.B09.1.454.CMB.1.raw
  modified_base (273)..(273): a, c, t, g, unknown or other
  misc_feature (273)..(273): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (350)..(358): a, c, t, g, unknown or other
  misc_feature (350)..(358): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcctccccctggccaccctcctccagacgcacctcngggggcacagcggccctgggctgcctggtcaaggactacttccatctacactactgagcgggctggcaggcncangnnnnnnnnn

SEQ ID NO: 266706 - DNA, 380 bp, Homo sapiens
  misc_feature: GYAE6OF02F851L.29.20.B09.1.454.CMB.1.raw
  modified_base (250)..(250): a, c, t, g, unknown or other
  misc_feature (250)..(250): n is a, c, g, or t
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (361)..(380): a, c, t, g, unknown or other
  misc_feature (361)..(380): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccacgtggggccagggaaccctggtccaccgtctcctcagcctccaccaagggcccatcggtccttcccccnggccaccctcctaccaagcgccacctcgtgggggcacagccggcctgggcngcctggtcaaggctacttctanacgancgntgagcgggctgggacaagggtcacgatagnnnnnnnnnnnnnnnnnnnn

SEQ ID NO: 266707 - DNA, 374 bp, Homo sapiens
  misc_feature: GYAE6OF02IUEDJ.29.20.B09.1.454.CMB.1.raw
  modified_base (356)..(356): a, c, t, g, unknown or other
  misc_feature (356)..(356): n is a, c, g, or t
  modified_base (361)..(374): a, c, t, g, unknown or other
  misc_feature (361)..(374): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcacgtctcctcagcctccaccaagggcccatccggtcttccccctggccacccctcctccaagacgccacctctgggggcacagcggcccgtgggctcgccgtggtcaaggactacttcctatacgatcgcgtgacgcgggctgggcaaggcgnatagnnnnnnnnnnnnnn

SEQ ID NO: 266708 - DNA, 556 bp, Homo sapiens
  misc_feature: GYAE6OF02FNVUT.29.20.B09.1.454.CMB.1.raw
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
tcagatagagtactcacgaccggtgctcgatttagtgtagtgtgaagggccgggttcaccatctccagagacaattccaacagcacgctgtatttgcacatgaacagcctgagagccgaggacacggccatatattattgtgcgaaacttcctttttgactggttattatcccctagtgaccatggggccagggaaccctggtcaccgtctcctcagcctccaccaagggcccatccggtcttccccctggccaccctcctccaagtcgccacctcgtcggggcacgagccggtcccgtgggtctcgtccgtggtacaacggtaccttacgttcctaacgtaccgactccggcgtaggacggtcggggctgggacctaagggccgtacagttacgcagntagactgcgntcgnagcgagcacgtacngagcagtgactnacgtancncngtacgtacncgcgtacgtcgtncnctcgacgngcgacgngacgtgtgtacgtactactactcgacgagacgagcgactacgtctactacgttactactctacgtacg

SEQ ID NO: 266709 - DNA, 604 bp, Homo sapiens
  misc_feature: GYAE6OF02HLQOE.29.20.B09.1.454.CMB.1.raw
  modified_base (189)..(189): a, c, t, g, unknown or other
  misc_feature (189)..(189): n is a, c, g, or t
  modified_base (253)..(253): a, c, t, g, unknown or other
  misc_feature (253)..(253): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (545)..(545): a, c, t, g, unknown or other
  misc_feature (545)..(545): n is a, c, g, or t
  modified_base (549)..(549): a, c, t, g, unknown or other
  misc_feature (549)..(549): n is a, c, g, or t
  modified_base (571)..(571): a, c, t, g, unknown or other
  misc_feature (571)..(571): n is a, c, g, or t
  modified_base (595)..(595): a, c, t, g, unknown or other
  misc_feature (595)..(595): n is a, c, g, or t
tcagatagagtactcacgaccggtgctcgatttagtgtagtgtgaagggccgggttcaccatctccagagacaattccaacagcacgctgtatttgcacatgaacagcctgagagccgaggacacggaccatatattattggtgacgtaaactttccttttgattaggttattactccctagtcgaccncgtgggaccacggaacctggtcaccgtctctcagcctcgacgacggccatccggtccttcccgnggaccaccctcctacaagacgacctacctcgcgggggacacggacgtacggcctgggactcgacgtacggtaccaaggtaccctacgttacctcgtacgacggtcgacgtgggaacggtcggtacgagggaccgaacggtcgaccgttagtaacgagcgtaagcagtaagccgtattagacgttanaccaaaggtcctaggaacngggaaccctttagaacncgacgttncttaaggccaggaccctaggtccagggttccagattccaanacgnangntagtacgtacganacanatagtacgacgagtacgacganactacgacgtactacacgtacganacgtacgac

SEQ ID NO: 266710 - DNA, 455 bp, Homo sapiens
  misc_feature: GYAE6OF02FQAKM.29.20.B09.1.454.CMB.1.raw
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (393)..(394): a, c, t, g, unknown or other
  misc_feature (393)..(394): n is a, c, g, or t
  modified_base (397)..(397): a, c, t, g, unknown or other
  misc_feature (397)..(397): n is a, c, g, or t
  modified_base (407)..(455): a, c, t, g, unknown or other
  misc_feature (407)..(455): n is a, c, g, or t
tcagatagagtactcacgaccggtgctcgatttagtgtagtgtgaagggcccgggttcaccatctccagagacaattccaacagcacgctgtatttgcacatgaacagcctgagagccgaggacacggccatatattattggtgcgaaaccttccttttgattggttattactccccctagtgacccacgtggggccagggaaccctggtccaccggtctccgtcacgcctccaccgaagggcccagtccgtccttcccccgtgccaccctcctccaagcncacctgnggggcacacgcggccgtgggctgccgtcggacaacggtactaccttcctataccgatcgcgtaggacgggccgggcttgggacgaacggcgtaccatagngcngnnacntcagctagannnnnnnnnnnnnnnnnnnnnnnnnnnnnnnnnnnnnnnnnnnnnnnnn

SEQ ID NO: 266711 - DNA, 373 bp, Homo sapiens
  misc_feature: GYAE6OF02HZHLG.29.20.B09.1.454.CMB.1.raw
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (358)..(373): a, c, t, g, unknown or other
  misc_feature (358)..(373): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccacaggcccatcgtcttcccctgccncctcctcaagncacctcgtgggggcacgcgccggccgtgggctgcctggtacaaggtacttacttcctagtacgagtcgctggacggcgggcgtcggcgaacggcgcatagnnnnnnnnnnnnnnnn

SEQ ID NO: 266712 - DNA, 377 bp, Homo sapiens
  misc_feature: GYAE6OF02HPQIO.29.20.B09.1.454.CMB.1.raw
  modified_base (353)..(377): a, c, t, g, unknown or other
  misc_feature (353)..(377): n is a, c, g, or t
tcagatagagtactcacgaccggtgctcgatttagtgtagtgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtcttccccctggcaccctcctccaagacgcacctctgggggcacgagcggccctgggctgcctggtcaaggactacttcctagtacgatcgctgagcgggctggcaggcgcatagnnnnnnnnnnnnnnnnnnnnnnnnn

SEQ ID NO: 266713 - DNA, 500 bp, Homo sapiens
  misc_feature: GYAE6OF01B8VFL.28.57.F02.1.454.CMB.1.raw
  modified_base (498)..(500): a, c, t, g, unknown or other
  misc_feature (498)..(500): n is a, c, g, or t
tcagagtacgctatcacgaccggtgctcgatttagctcgatatagttgggtttggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtgggagaggagcggaaattggaactagggttgtggggccagggagcccgtgggtcaccgtctcctcagcctccaccaagggcccatcggtcttcccctggcgccctgctccaggacgcacctccgagagcacagcggccctgggctgcctggtcaaggctactccatagcgtactctgacgcgggctggcaaggcgcatagnnn

SEQ ID NO: 266714 - DNA, 168 bp, Homo sapiens
  misc_feature: GYAE6OF01A5OMV.28.57.F02.1.454.CMB.1.raw
  modified_base (164)..(168): a, c, t, g, unknown or other
  misc_feature (164)..(168): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagcgggctggcaaggcgcatagnnnnn

SEQ ID NO: 266715 - DNA, 526 bp, Homo sapiens
  misc_feature: GYAE6OF01DN21N.28.57.F02.1.454.CMB.1.raw
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtcccctgagactctcctgtgcagcctctggattcaccttcagtatttatgctatgcactggggtccgccaggctccgaggggaagggctggaatatgtctcaggtattagaagtatgacgaataacatatattatgacaaactctgtgaaggcagattcacatctcaggacaatcaagacacgctgtatcttcaatgggacagcctgagagctgacganacggntgtatattacgtggtagggagagggagacgggaattgggaacgttaggggttggtggggccgtaaggggg

SEQ ID NO: 266716 - DNA, 523 bp, Homo sapiens
  misc_feature: GYAE6OF01ALLKR.28.57.F02.1.454.CMB.1.raw
  modified_base (456)..(456): a, c, t, g, unknown or other
  misc_feature (456)..(456): n is a, c, g, or t
  modified_base (476)..(476): a, c, t, g, unknown or other
  misc_feature (476)..(476): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctcagggacaattccaagacacgctgtatcttcaatgggcagcctgagagctgaggacacggntgtatattacgtgtgggagngggagcggtaagttgggaacgttaggggttgtggggccgtaaggggg

SEQ ID NO: 266717 - DNA, 654 bp, Homo sapiens
  misc_feature: GYAE6OF01D2JWK.28.57.F02.1.454.CMB.1.raw
  modified_base (156)..(156): a, c, t, g, unknown or other
  misc_feature (156)..(156): n is a, c, g, or t
  modified_base (254)..(254): a, c, t, g, unknown or other
  misc_feature (254)..(254): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgtttcgtntaggcgtatttaaagtgtcagtgtgaggtgcagctggtggagtcgtggggagcttggccagccgtgggggtccctgagctctctgcgcagtcctgtgnttcaccttgagttatttgngtntatgcgtcgtcggtccgcgacgcgtacggagggaggagtagtagtagtgtcgtacgtagtaagttaagtaagtaagtagtaacgtaaataaataataattaattatactactaactacgtagtaggtaaggtacgtagtacgtactactacgtacgtacgtaacgtaacgtaacgtaacgaaacgaacgtaacgtacgttacgttacttacttaacgtaacgtacggacgtacgtacgtacggacgtacgtacgtacggacggacggtacgtacgtagttagttacgttacggttaggtaggtaggtagggaacgggtaacgggtaacggttaacgggttaacgggttagggttacggggtcggggtacgggtacggg

SEQ ID NO: 266718 - DNA, 543 bp, Homo sapiens
  misc_feature: GYAE6OF01DH79I.28.57.F02.1.454.CMB.1.raw
  modified_base (324)..(324): a, c, t, g, unknown or other
  misc_feature (324)..(324): n is a, c, g, or t
  modified_base (422)..(422): a, c, t, g, unknown or other
  misc_feature (422)..(422): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagcggtggtttcgtgtaggcgtattttaagtgtcagtgtgaggtgcagctggtggagtctgggggaggcttggtccagcctggggggtccctgagctctcctgtgcagcctctggattcacctttcagttatttatgctatgcactgggtccgccaggctccgagggaagggactggaatntgtctcaggtattagaagtaatgagaataacatatattatgcaactactgtgaggagagattcaccatactccaggacaacttacaacgaacacgctntatacttactaataggcgagcctagagagcgtgaggacgacggacgtagtattattacgttaggtagggtaggaggaggaggtaagtaggtaacggtagggttgggtggggtcggacgggg

SEQ ID NO: 266719 - DNA, 167 bp, Homo sapiens
  misc_feature: GYAE6OF01CHY33.28.57.F02.1.454.CMB.1.raw
  modified_base (165)..(167): a, c, t, g, unknown or other
  misc_feature (165)..(167): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgggctggcaaggcgcatagnnn

SEQ ID NO: 266720 - DNA, 516 bp, Homo sapiens
  misc_feature: GYAE6OF01DF9O4.28.57.F02.1.454.CMB.1.raw
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaagggactggaatatgtctcaggtattagaagtatgacgaataacatatattatgacaaactctgtgaagggcagattcacatctcaggacaattccaagaacacgctgtatcttacaaatgggcagcctgagagctgaggacacggctgtatattacgtggtggagnggagnggaagttggaactagggttgtggggcctagggg

SEQ ID NO: 266721 - DNA, 533 bp, Homo sapiens
  misc_feature: GYAE6OF01BHQCT.28.57.F02.1.454.CMB.1.raw
  modified_base (499)..(499): a, c, t, g, unknown or other
  misc_feature (499)..(499): n is a, c, g, or t
  modified_base (528)..(529): a, c, t, g, unknown or other
  misc_feature (528)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
tcagagtacgctatcacgaccggtgctcgatttagctcgatatagttgggtttgggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtgggagaggagcggaattggaactagggttgtggggccagggagcccgtggtcaccggtctcctcagcctcaccaagggcccatccggtccttcccctggccgcccctcgcctccgaggacgccaccctccgagacgccacaggccggccctggggcctcggccctgggtccaagggacttacttccatacgccgtactcgngacgcgggctggccgaaggccgcgatagnngngn

SEQ ID NO: 266722 - DNA, 518 bp, Homo sapiens
  misc_feature: GYAE6OF01AQ6SZ.28.57.F02.1.454.CMB.1.raw
  modified_base (454)..(454): a, c, t, g, unknown or other
  misc_feature (454)..(454): n is a, c, g, or t
  modified_base (476)..(476): a, c, t, g, unknown or other
  misc_feature (476)..(476): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcacctttcagtatttatgctatgcactggtccgcaggctccagggaggactggaatatgtctcaggtattagaagtaatgcgaataacatatattatgcaaactctgtgaagggcagattcaccatctccaggacaattccaagacacgctgtatcttacaatgggacagcctgagagctgagacacggntgtatagttacgtgtagggagnggagcggtaattgggaacgtaggggttgtggggccgtagggg

SEQ ID NO: 266723 - DNA, 512 bp, Homo sapiens
  misc_feature: GYAE6OF01CHX00.28.57.F02.1.454.CMB.1.raw
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaaggactggaatatgtctcaggtattagaagtaatgacgaataacatatattatgacaaactctgtagaaggcagattcacatctcaggacaatccaagacacgctgtatctcaaatgggcagcctgagagctagaggacacggctgtatattacgtgtagggagnggagcggaattggaacgtgggttgnggggcgaaggg

SEQ ID NO: 266724 - DNA, 562 bp, Homo sapiens
  misc_feature: GYAE6OF01ELSS5.28.57.F02.1.454.CMB.1.raw
tcagagtacgctatcacgaccggtgctcgatttagctcgatatagttgggtctgggagagggacgcccccgcccgttcgggtttcccaggtgttctctatttggtgatcagcactgcacacagaagagtcatgacggagtttgggctgagcttgggttttccttgttgcttatttttaaaggtgtccagtgtgaggtgcagctggtggagtcgtgggggaggcgttggtccagccgtggggggtccctgagactctcctgtgcagcctctggattcaccttcagttatttatgctatgcacgtgggtcccgcgaggcctccgaggggaagggactaggaatatgtctcgaggttattagaagtatgacgaataacatatattatgactaaactctagtaggaaggcagtattcacctatcctacgaggactaactaccaaagaacacgctgtatcttacaagtgggcagcctagagagctgagacgacggctagtatattacgtggtagggagaggagaggtaagttgggaacgttaggggttggtcggggcgtaacggggg

SEQ ID NO: 266725 - DNA, 537 bp, Homo sapiens
  misc_feature: GYAE6OF01BLATZ.28.57.F02.1.454.CMB.1.raw
  modified_base (364)..(364): a, c, t, g, unknown or other
  misc_feature (364)..(364): n is a, c, g, or t
  modified_base (474)..(474): a, c, t, g, unknown or other
  misc_feature (474)..(474): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgttagctattttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggctgggaatatgtctcaggtattagaagtaatgcgaaataacatatattangcaaactctgtgaaagggcagattcaccatctccagggacaattccaagaacacgctgtatcttcaaatgggcagcctgagagctgaggacgacggctgtatagttacgnggttgggaggngggagacgggaattggggaacgttagggggtttggtgggggtccgaaggggg

SEQ ID NO: 266726 - DNA, 525 bp, Homo sapiens
  misc_feature: GYAE6OF01D8JZJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggctccgaggggaagggactggaatatgtctcaggtattagaagtaatgcgaaataacataatattatgcaaactctagtgaaagggcagattcacatctccaggacaattccaagaacacgctgtatcttacaaatgggcagcctgagagctgagacacggctgtatattacgtgtgggagaggagcggaagttgggaacttaggggttgtggggcgaagggg

SEQ ID NO: 266727 - DNA, 516 bp, Homo sapiens
  misc_feature: GYAE6OF01ACPKR.28.57.F02.1.454.CMB.1.raw
  modified_base (413)..(413): a, c, t, g, unknown or other
  misc_feature (413)..(413): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcacctttcagtatttatgctatgcactgggtccgccaggctccagggaaggctggaatatgtctcaggtattagaagtaatgcgaaataacatatattatgcaaactctgtgaagggcagattcacatctcaggacaattcaagacacgntgtatcttcaaatgggacagcctgagagctgaggacacggctgtatattacgtgtagggagnggagcggaattgggaacttaggggttgtggggctaacgggg

SEQ ID NO: 266728 - DNA, 555 bp, Homo sapiens
  misc_feature: GYAE6OF01BP55X.28.57.F02.1.454.CMB.1.raw
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggctatttaaagtgtcagtgtgaggtgcagctggtggagtcgtgggggagcttggccagcctggggggtccctgagctctcctgtgcagcctntggattcacttcagtatttatgntatgcactggtccgccgngcgtccgaggaggagaggataatgtctgaggtattagaagtaatagagaataanatatatatananatagtgagagagatatacacactactacgacgactaactacaacgaacacgtactacgtactactacgtaagtacgacgacgtacgtacgagtacgacgagacgacgtacgtacgtagtagttagttagtaggtagggaggaggacggtaggtaaggtacggtaacggttagggtacgggtcgggtcgggtacggg

SEQ ID NO: 266729 - DNA, 554 bp, Homo sapiens
  misc_feature: GYAE6OF01C5AEK.28.57.F02.1.454.CMB.1.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtgggggaggcttggtccagccgtggggggtccctgagctctcctgtgcagcctctggattcaccttcagttatttatgctatgcacgtgggtcccncaggcctccgagggaaggctggaatatgtctnaggtattaagaagtatgacgaaataacatataatatgacaaactntgtagaaggcagtattcacatctaccgaggacaattaccaaagaacacgactagtatacttacaaagtcgggacagcctagaagagcgtagaacggacgacggtctaggtaattagtacgtggagggagaggagacggaagttggaacggttagggtcggtggggcgtaacgggg

SEQ ID NO: 266730 - DNA, 572 bp, Homo sapiens
  misc_feature: GYAE6OF01CXD2N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagcctggggggtccctgagactctcctgtgcagcctctggattcaccttcagttatttatgctatgcacgtgggtcccgccaggcctccgaggggaaggactgggaatatgtctcgaggtattagaagtaatgacgaaataacattataattatgactaaactctagtagaagggcagattcacatctcaggacaattaccaagaacacgactagtatcttacaaagtgggacacgccgtagagagcgtaggaaggacgacggcttagtaattagttacgtgggtagggaggaggaggacgggtaagttagggtaacgttaggggttcgggtgggggccgtaacggggg

SEQ ID NO: 266731 - DNA, 533 bp, Homo sapiens
  misc_feature: GYAE6OF01DTWMP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttagctattttaaggtgtcagtgtgaggtgcagctggtggagtctgggggaggcttggtccagccgtggggggtccctgagactctcctgtgcagcctctggattcaccttcagtatttatgctatgcactgggtccgccaggctccgagggaagggactggaatatgtctcaggtattagaagtaatgacgaaataacataatattatgacaaactctgtagaagggcagattcaccatctcaggacaattaccaagaacacgctgtatcttacaaagtgggacaacgcctagagagctgacggacacggctagtatattacgtgtgggagaggagacggaagttgggaaacgtagggttaggtggggccgtagggg

SEQ ID NO: 266732 - DNA, 515 bp, Homo sapiens
  misc_feature: GYAE6OF01D9SQF.28.57.F02.1.454.CMB.1.raw
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaagggactggaatatgtctcaggtattagaagtatgcgaataacatatattatgcaaactctgtgaagggcagattcaccatctccaggacaattccaagacacgctgtatctnaatgggacagcctgagagctaggacgacacggctgtatattacgtgtgggagnggagcgaagttggaacgtagggttggtgggccgaggg

SEQ ID NO: 266733 - DNA, 603 bp, Homo sapiens
  misc_feature: GYAE6OF01EA6GE.28.57.F02.1.454.CMB.1.raw
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (374)..(374): a, c, t, g, unknown or other
  misc_feature (374)..(374): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctattttaaaggtgtcagtgtgaggtgcagctggtggagtcgtgggggaggcttggtccagccctggggggtccctgagactctcctgtgcagcctctggattcacctttcattatttatgctatgcactgggtccgccaggctccgagggaagggactggaatntgtctnaggtattagaagtaatgacgaataacatatatatgactaaactntagtagaagggcaagtacttaccaacctaatccgttacccgaagggaactaactttaccgaaaggaaccaacggtccttagttacttcttacgaaagttcgggacaagtccgtaggagaagtccgtaggacggacgtacggcttaggtacttaagttagtaggttggggaaggtaggaggtacggtaaagttcgggaacgttaggggttcggtcggggccgtaaggggg

SEQ ID NO: 266734 - DNA, 531 bp, Homo sapiens
  misc_feature: GYAE6OF01AMJPI.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccnccaggctccagggaagggactggaatatgtctcaggtattagaagtaatgacgaataacatatattatgacaaactctgtgaagggcagattcacatctccaggacaattccaagaacacgctgtatcttacaaatgggacagcctgagagctgaggacacggctaggtatagttactggtagggagaggagcggtaagttgggaacgttagggttggtggggccgtaagggg

SEQ ID NO: 266735 - DNA, 531 bp, Homo sapiens
  misc_feature: GYAE6OF01ALU2K.28.57.F02.1.454.CMB.1.raw
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgcgaataacatatattatgacaaactctgtgaagggcagattcacatctccaggacaatccaagacacgctgtatcttacaatgggcagcctagagagctgaggacacggntgtatattacgtggtagggagngggaggacggaagttcgggaacggttaggggttggtgggggccgtaagggg

SEQ ID NO: 266736 - DNA, 620 bp, Homo sapiens
  misc_feature: GYAE6OF01D88MM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccaggccgtggggggtccctgagactctcctgtgcagcctctggattcaccttcagttatttatgctatgcacgtgggtcccgccaggcctccgaggggaaggactggaatatgtctgaggtattagaagtaatgacgaaataacattaatattaatgactaaactctagtaggaagggcagtattacacctatctaccgaagggaactaattaccaaagaacacgctagtatcttacaaagtgggacacgcctaggagacgacgtaggaaggaccgacgggtacttacggttaattaacgtttacggtagggttaggggaaggtaaggggaggtaccgggtaaagtttacggggaaacggttagggggtttacgggtcgggggcccggtaaacggggg

SEQ ID NO: 266737 - DNA, 567 bp, Homo sapiens
  misc_feature: GYAE6OF01BESDX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccgccaggctccgagggaagggactggaatatgtctcaggtattagaagtatgcgaataacatatattatgacaaactctgtagaaggcagattcacatctcgaggacaatccaagacacgctgtactcttacaagtgggactacgcctaggacgtagctagagggacacgggctaggtacttaagttacgtgggttagggaggtagggacgtacgggtaaagtttcggggaaacgttagggggtttcgggtcggggggacccgtaacgggggg

SEQ ID NO: 266738 - DNA, 545 bp, Homo sapiens
  misc_feature: GYAE6OF01B3ZFJ.28.57.F02.1.454.CMB.1.raw
  modified_base (293)..(293): a, c, t, g, unknown or other
  misc_feature (293)..(293): n is a, c, g, or t
  modified_base (530)..(530): a, c, t, g, unknown or other
  misc_feature (530)..(530): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttagctattttaaaggtgtcagtgtgaggtgcagctggtggagtctgggggaggcttggtccagcctggggggtccctgagactctcctgtgcagcctctggattcaccttcagtatttatgctatgcactgggtccnccaggctccgagggaaggactggaatatgtctcaggtattagaagtaatgacgaataacatatattatagactaaactcgtagtagaagggcagtattcaaccatctaccgaggtaacaattaccaagacacgctgtactctacaatgggacagcctagagagctagacggacacggctagtatagttacgtggtagggaggtacggagaggtaaagttgggaacgttaggggttgnggggccgtaaggggg

SEQ ID NO: 266739 - DNA, 542 bp, Homo sapiens
  misc_feature: GYAE6OF01DZOUV.28.57.F02.1.454.CMB.1.raw
  modified_base (368)..(368): a, c, t, g, unknown or other
  misc_feature (368)..(368): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactgggaatatgtctcaggtattagaagtaatgacgaataacatatattangacaaactctgtgaagggcagattcacatctccaggacaattccaagaacacgctgtatcttacaatgggcaagcctagagagctgaggacacggctaggtatattacgtggtagggagagggaggcgggtaaagttgggaaacttagggggtttggtgggggcccgaaggggg

SEQ ID NO: 266740 - DNA, 530 bp, Homo sapiens
  misc_feature: GYAE6OF01B8O9W.28.57.F02.1.454.CMB.1.raw
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgagggaaggactggaatatgtctcaggtattagaagtaatgacgaaataacatatattatgacaaactctgtagaagggcagatcacatctccaggacaataccaagaacacgctagtatcttacaaatggacagcctgagagctgagacacggctagtatattacgtggtagggagnggagcggtaagttgggaacgtaggggttggtggggcgtaaggggg

SEQ ID NO: 266741 - DNA, 528 bp, Homo sapiens
  misc_feature: GYAE6OF01EZXQI.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaataacatatattatgacaaactctagtgaagggcagatcacatctcgaggacaatccaagaacacgctgtatcttacaagtgggacagcctagagagctgagacacggctgtatagttacgtgtagggagaggagacggaattagggaacgtaggggttggtggggcgtagggg

SEQ ID NO: 266742 - DNA, 555 bp, Homo sapiens
  misc_feature: GYAE6OF01BU9O2.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtctgggggaggcttggtccagcctggggggtccctgagactctcctgtgcagcctctggattcacctttcagttatttatgctatgcactgggtcccnccaggcctccgagggaagggactggaatatgtctcgaggtattagaagtaatgacgaaataacatatattatgacaaactctagtgaagggtcagattcacatctcaggacaattaccaagaacacgctagtatcttacaaagtgggacagcctagagagctagacggacacggctgtattaatacgtggtagggaggacggaggacgggtaaagttcgggaaacgttaggggttgggtcggggtcggaaacggggg

SEQ ID NO: 266743 - DNA, 740 bp, Homo sapiens
  misc_feature: GYAE6OF01D5JML.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggacttcaccttcagttatttatgctatgcacgtcgggtccgccaggcctccgaggggaaggactggaatatgtctcgaggttatagaagtaatgacgaaataacatatattatgactaaactcgtagtaggaagggctaagtactttaccgaaccctagttacccgtaacccgtaacggggtaaaccctaaacgtttaacccgaaaacggtaaacccgtacggtaccgtttacgttaacgtttaccgtttaaacgtaaaacggttcggggaacccgtaacggtacccgttaaggaacgggtaacggaccgttagggaaccgggaccgaccggtaccgttaggttaaacgttaacgttttaccggttagggggtaggggtaacgggtaacggggtaacggtaaccggggttaaagtttaacgggggtaaacgggtttagggggtttacggggtacggggggcccggtaaacgggggg

SEQ ID NO: 266744 - DNA, 512 bp, Homo sapiens
  misc_feature: GYAE6OF01CAVWQ.28.57.F02.1.454.CMB.1.raw
  modified_base (297)..(297): a, c, t, g, unknown or other
  misc_feature (297)..(297): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccaggggaggactggaatatgtctcaggtattagaagtaatgcgaataacatatattatgcaaactctgtgaagggcagattcacatctcaggacaattcaagacacgctgtatcttcaatgggcagcctgagagctgaggacacggctgtatattacgtgtgggagnggagcggtaattgggaacttaggggttgtggggccagggg

SEQ ID NO: 266745 - DNA, 534 bp, Homo sapiens
  misc_feature: GYAE6OF01DBEIW.28.57.F02.1.454.CMB.1.raw
  modified_base (445)..(445): a, c, t, g, unknown or other
  misc_feature (445)..(445): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgaggggaggactggaatatgtctcaggtattagaagtaatgacgaataacatatattatgacaaactctgtgaaggcagattcacatcacaggacaattccaagacacgctgtactctacaagtgggcagcctagagngctaggacgacgacgtctagtattattacgtggtaggaggtacggaggtagtaaggttgaacggttgggttgggtcgggcggtaacggg

SEQ ID NO: 266746 - DNA, 553 bp, Homo sapiens
  misc_feature: GYAE6OF01C6SM9.28.57.F02.1.454.CMB.1.raw
  modified_base (537)..(537): a, c, t, g, unknown or other
  misc_feature (537)..(537): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtcccgccaggctccgaggggaagggactggaatatgtctcaggtattagaagtaatgacgaataacattatattatgacaaactctgtagaagggcagattcaccatctaccaggacaattccaaagaacacgctagtattcttacaaatcgggacagcctaggagagcgtgaggacacgggctgtattatacgtggtagggagaggaggacggtaagttagggaaacgttaggggttggnggggtaccggacgggg

SEQ ID NO: 266747 - DNA, 553 bp, Homo sapiens
  misc_feature: GYAE6OF01ALTID.28.57.F02.1.454.CMB.1.raw
  modified_base (361)..(361): a, c, t, g, unknown or other
  misc_feature (361)..(361): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgttttcgtgtagctatttaagtgtcagtgtgagtgcagctggtggagtctgggggagcttggtccagacgtggggggtccctgagactctcctgtgcagcctcgtggtattccaccttcagttatttatgctatgcacgtcggtcccgcgaggctaccgagggaggacgtaggaatagtgtactacgaggttatagaagtagtgacgaaataanatatagttatgtactaactctgtaggaggacagtactcactagtctacgagactaatcgaaanacgacnctagtactacgtagaactgggacaacgcgtagacgagtcgtagacgacgcgtatgtaattactagtagggtggaggtaggagtaggtaagtacgggtacgttaggggtcgtcgggacgacggg

SEQ ID NO: 266748 - DNA, 625 bp, Homo sapiens
  misc_feature: GYAE6OF01BP9UG.28.57.F02.1.454.CMB.1.raw
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctattttaaaggtgtccagtgtgaggtgcagctggtggagtcgtgggggaggcgttggtccaggccgtggggggtccctgagactctcctgtgcagcctctggacttcaccttcagttatttatgctatgctacgtgggtcccgccaggcctccgaggggaaggactaggaatatgtctcgtagtattagaagtanagagaaataacatatattangacaaactctgtagaaggcaagtacttacgaacctattaccgacgaagggaacctaacgttaccgaaagtaaccaccgtacttagtaactccttaacgaaagtcgggacctaacgccgtagacggacgcgtaggaacggaccgacggtactagttacgttaagttcggtaggttaggggaggtaagggaacgtagggtaaagttagggaacggtttagggggttcggacgggggtccgtaacggggg

SEQ ID NO: 266749 - DNA, 562 bp, Homo sapiens
  misc_feature: GYAE6OF01BJB5X.28.57.F02.1.454.CMB.1.raw
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtctgggggaggcttggtccagcctggggggtccctgagactctcctgtgcagcctctggattcaccttcagttatttatgctatgcacgtgggtccgccaggcctaccgaggggaacggactggaatatgtctcaggtattagaagtatgacgaataacatatattatgactaaactctagtagaaggacagtattcgaccatcctacgaggaactaataccaaagacacgtactagtactcttacgaatcgggacagccgtagagtagcctgaacggacacggnttagtattattacgtggtagggaggaggaggtacggaagttcggaacgttaggggttcggtcgggggcgtaacgggg

SEQ ID NO: 266750 - DNA, 544 bp, Homo sapiens
  misc_feature: GYAE6OF01DJKHK.28.57.F02.1.454.CMB.1.raw
  modified_base (379)..(379): a, c, t, g, unknown or other
  misc_feature (379)..(379): n is a, c, g, or t
  modified_base (507)..(507): a, c, t, g, unknown or other
  misc_feature (507)..(507): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtcccctgagactctcctgtgcagcctctggattcaccttcaatatttatgctatgcactcgggtccgccaggctccgagggaaggactggaatatgtctcaggtattagaagtaatgacgaataacatatattatgacaaactntgtagaagggtcagtattccacctatcctacgaggacaattaccaagaacacgtctagtatcttacaaatgggcagcctagagagcgtgaaggacacggctagtactattacgtgtgggagagggagnggaaagttgggaacttagggtggtggggcccaagggg

SEQ ID NO: 266751 - DNA, 542 bp, Homo sapiens
  misc_feature: GYAE6OF01B72FX.28.57.F02.1.454.CMB.1.raw
  modified_base (519)..(519): a, c, t, g, unknown or other
  misc_feature (519)..(519): n is a, c, g, or t
  modified_base (538)..(542): a, c, t, g, unknown or other
  misc_feature (538)..(542): n is a, c, g, or t
tcagagtacgctatcacgaccggtgctcgatttagctcgatatagttgggtttgggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatggtagcctgagagctgaggacacggctgtatattactgtgggagaggagcggaagttggaactaggggttgtggggccaggggagccctggtcaccgtctcctcacgcctccaccgaacgggccccagtccggtccttccccccgtggcccgccccgtcgcctcccgaggacgccacccgtccgagacgccacgacgccggcccgtcgggctcgccgtcggtcaacggacctacttccatacgcgtactcgtgacgcgggntcggcgaggcgacgacagnnnnn

SEQ ID NO: 266752 - DNA, 592 bp, Homo sapiens
  misc_feature: GYAE6OF01CVCPI.28.57.F02.1.454.CMB.1.raw
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgttcgtgtaggctactttaaagtgcagtgtgagtgcagctggtggagtcgtggggagcttggccagccgtgggggtccctgatctctctgngcgagtcctntagtntctactctagtattatntctntgcgtcgtcggtcgcgacgcgtcgaggaggagtagtagtagtgtctagtagtagtaagtaagtagtagtaacgtaataataataataatacgtacgtactaacgtacgtagtagagacgtagtacgtactactacgtacgtacgtacgaacgtaacgtaacgtaacgaacgtacgtacgtagtactactaacgtagtacgacgacgtacgtagtacgtacgtacgtacgacgacgacgtacgtagtacgttagtaggtaggtaggaggtaggaggtaggtaaggtaggtaggtagggtcgggtgggtacgggtacgg

SEQ ID NO: 266753 - DNA, 580 bp, Homo sapiens
  misc_feature: GYAE6OF01BVB0N.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttactattttaaaggtgtccagtgtgaggtgcagctggtggagtctgggggaggcttggtccagcctggggggtccctgagactctcctgtgcagcctctggattcaccttcagtatttatgctatgcactgggtccnccaggctccgaggggaagggactgggaatatgtctcgagtattagaagtatgacgaataacatatatatgacaactctgtgaaggcagacttcaccatctaccgagggaacaacgttccaaagaaccacgcttagtaattcttacaaagttgggactacgccgtagaggagtcgtaggaacggacacggtctagttatattacgtgggtacgggaggaagggtaggacggtaagttacgggtaaacgttaggggttaggcgggggtccggtaggggtacccgg

SEQ ID NO: 266754 - DNA, 673 bp, Homo sapiens
  misc_feature: GYAE6OF01ECTJ4.28.57.F02.1.454.CMB.1.raw
  modified_base (307)..(307): a, c, t, g, unknown or other
  misc_feature (307)..(307): n is a, c, g, or t
  modified_base (403)..(403): a, c, t, g, unknown or other
  misc_feature (403)..(403): n is a, c, g, or t
  modified_base (453)..(453): a, c, t, g, unknown or other
  misc_feature (453)..(453): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgagtgcagctggtggagtcgtgggggaggcgttggtccaggccgtggggggtccctggagactctcctgtgcagcctctggattccaccttcagttatttatgctatgctacgtcgggtcccnccgaggcctaccggaaggggaacggacgtaggaattagtgtctacgtaggttattaagaagtaatgacgaaataactaatatatatgactaaactntagtagaagggcagtactcactatcctacgaggaactaacttaccgaaanaacacgtctagtactcttacaagtcgggacgacgccgtagacgtacgtacgtagggaacggtacggacggtcgttaagttaacgttaacgtttacgggttagggtaacggggaagggtaaacggggtaacgggtaaacggggttaaagggtttaacggggttaaacgggtttaacggggggtttgggggtaacccggggtaacggggtaaacccgggggg

SEQ ID NO: 266755 - DNA, 536 bp, Homo sapiens
  misc_feature: GYAE6OF01A7E3Q.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattatgctatgcacgtggtccgccaggctccgagggaaggctggaatatgtctcaggtattagaagtatgacgaaataacatatattatgacaaactctgtgaaggcagattcacatctacaggacaactcaagacacgctgtatcttacaatgggacacgcctagagagctagaggacacggtctagtatattacgtggtagggagagggaggacggtaagttcgggaaacgttaggggttggtggggccggtaacggggg

SEQ ID NO: 266756 - DNA, 532 bp, Homo sapiens
  misc_feature: GYAE6OF01CAMD4.28.57.F02.1.454.CMB.1.raw
  modified_base (477)..(477): a, c, t, g, unknown or other
  misc_feature (477)..(477): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggcctccgaggggaagggactggaatatgtctcaggtattagaagtaatgacgaataacatatattatgacaaactctagtgaagggcagattcaccatctcaggacaattccaagacacgctgtatcttacaatgggcagcctgagagcgtgaggacacggctagtatagttacgnggtagggagagggagacggaagttggaacgttaggggttggtggggcgtacgggg

SEQ ID NO: 266757 - DNA, 665 bp, Homo sapiens
  misc_feature: GYAE6OF01BERF2.28.57.F02.1.454.CMB.1.raw
  modified_base (659)..(660): a, c, t, g, unknown or other
  misc_feature (659)..(660): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttacaaaatgggcagcctgagagctgaggacacggctgtatatactgtgggagaggagcggaattgggaactagggttgtggggccagggcgcccgtggtccaccgtctccgtcacggccctcccgaaccgaacgggcccctaagtcccgggttcccctttccccccgtagggccccgtcccccgttcggccccttaccccgaacgggacgcccgaacccgtcccggaacgaccgccaacccgacggcccgggccccgttacggggccttccgggcccgttaggggtacccgaaacgggtacccttaacccgtttacccaagttacggtacccggttaaccttaccggtcgggaacgggtcccggggtacgttcgggaccgaaacgggccgtaccgaagttaacggnngngng

SEQ ID NO: 266758 - DNA, 523 bp, Homo sapiens
  misc_feature: GYAE6OF01E0ZVS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaaggactggaatatgtctcaggtattagaagtaatgacgaataacatatattatgacaaactctgtgaagggcagatcacatctcaggacattcaagacacgctgtatcttacaaatgggacagcctagagagctgaggacacggctgtatattacgtggtgggagaggagcggtaagttgggaacgtaggggttgtggggccgtaagggg

SEQ ID NO: 266759 - DNA, 530 bp, Homo sapiens
  misc_feature: GYAE6OF01E1WEF.28.57.F02.1.454.CMB.1.raw
  modified_base (366)..(366): a, c, t, g, unknown or other
  misc_feature (366)..(366): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagcctggggggtccctgagactctcctgtgcagcctctggattcaccttcagtatttatgctatgcactgggtccgccaggctccgagggaagggactggaatatgtctcaggtattagaagtatgacgaataacatatattangacaaactctgtgaagggcagatcacatctccagggacaattccaaagaacacgctgtactcttacaaatgggacagcctagagagctgaggacacggctgtatattacgtggtgggaggaggagacggaagttgggaacgttaggggttggtggggcgagggg

SEQ ID NO: 266760 - DNA, 548 bp, Homo sapiens
  misc_feature: GYAE6OF01C68EU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtgggtccgccaggctccgaggggaaggactggaatatgtctcgaggtattagaagtaatgacgaataacatatattatgacaaactctagtagaagggcagattcacatctcaggacaatccaagacacgctgtatcttacaagtgggacacgcctagagagctaggaggacgacggcttagtattagttacgtggtagggaggagggaggacggtaagttagggaacgttaggggttcggtggggcgtaacgggg

SEQ ID NO: 266761 - DNA, 613 bp, Homo sapiens
  misc_feature: GYAE6OF01D589L.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtccnccaggctccgaggggaagggactggaatatgtctcaggtattagaagtaatgacgaataacatatattatgactaaactctaggtagaagggcaagtacttaccaaccatcctaccgaagggaacctaacttaccgaaagaaccacgactagttactacttacaaagtcgggacacgtcctaggagtacgcttaggaacggaccgtacggcttaagtacttaagtttacggtgggtagggaagggagggaaggtacgggtaaagttacgggtaaacggttaggggtttcgggtacgggggccgtaacgggggg

SEQ ID NO: 266762 - DNA, 558 bp, Homo sapiens
  misc_feature: GYAE6OF01CJJM4.28.57.F02.1.454.CMB.1.raw
  modified_base (446)..(446): a, c, t, g, unknown or other
  misc_feature (446)..(446): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagccgtggggggtccctgagactctcctgtgcagcctctggattccacctttcagttatttatgctatgcacgtgggtccgccaggctccgaggggaagggactggaatatgtctcaggtattagaagtaatgacgaaataacatataattatgacaaactctgtagaagggcagattcacatctacagggaactaattccaagaacacgctagtatccttanaagtgggacagcctgagagcgtgaggcacggctagtatagttacgtggtagggagagggaggacggtaagttcgggaaacgttagggggtttggtgggggccgtaacggggg

SEQ ID NO: 266763 - DNA, 671 bp, Homo sapiens
  misc_feature: GYAE6OF01CHFYD.28.57.F02.1.454.CMB.1.raw
  modified_base (301)..(301): a, c, t, g, unknown or other
  misc_feature (301)..(301): n is a, c, g, or t
  modified_base (350)..(350): a, c, t, g, unknown or other
  misc_feature (350)..(350): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtcccnccaggcctccgaggggaaggactggaatatgctcaggtattagaagtangacgaaataacatatattatgacaaactctagtagaagggcagtacttcaccgtatacctccgaagggtaacctaacgttaccaaagtaaccacgtacttagtacttcgttacaaaagttcgggacacggtccctaggaaggtacgtaccgttaggaacggggtaccaaccggggtcttaggtaaacgttaagttttaaccgtaggggttagggggaaaggtaacggggtaaacgggtacccggggttaaaagtttaccgggggtaaaacggtttaggggggtttaggggtccgggggggtaacccggtaaaccggggggg

SEQ ID NO: 266764 - DNA, 535 bp, Homo sapiens
  misc_feature: GYAE6OF01A52TW.28.57.F02.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (369)..(369): a, c, t, g, unknown or other
  misc_feature (369)..(369): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
  modified_base (497)..(497): a, c, t, g, unknown or other
  misc_feature (497)..(497): n is a, c, g, or t
  modified_base (502)..(502): a, c, t, g, unknown or other
  misc_feature (502)..(502): n is a, c, g, or t
  modified_base (529)..(529): a, c, t, g, unknown or other
  misc_feature (529)..(529): n is a, c, g, or t
tcagagtacgctatcacgaccggtgctcgatttagctcgatatagttgggtcgtgggaggaggagcccccgcccctcgggtttcccaggtgttctcatttggtgatcagcactgcacacagaagagtcatgacgggagtttgggctgagctgggttttccttgttgctattttaaaggtgtccagtgtgaggtgcagctggtggagtctgggggaggcttggtccagccgtggggggtctctgagactctcctgtgcagcctctggattcaccttcagtatttangctatgcacgtgggtccncaggctccgagggagggactggaatatgtctcagtatagaagtaatgacgaataacatatattagngacaaaactcgtgtaggaagggacagtacttacacgatctccgaagggactaatacaagaacacgntntatcttanaaagtggacagcctagagngctgacggacnccggatcgtaatagtcgttggnggaanaggagacgtagtaggacgtagggtggngggacg

SEQ ID NO: 266765 - DNA, 592 bp, Homo sapiens
  misc_feature: GYAE6OF01CUA98.28.57.F02.1.454.CMB.1.raw
  modified_base (490)..(490): a, c, t, g, unknown or other
  misc_feature (490)..(490): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgctattttaaaggtgtccgagtgtgaggtgcaggctggtggagtctgggggagcttggtccagccgtggggggtccctgagactctcctgtgcagcctctggattcaccttcagttattagtgctatgcacgtgggtccgccaggcgtaccgagggtaaggactaggaatatagtctacgaggtattaagaagtaatgacgaaataacatataatatgactaaactctagtagaaggcagattacactatctacgaggacaatccaaagacacgtctagtatcttacaagtcggacaacgcgtagagacgacgtagacggactaccggnttaggtattaacgttacgtagggttaggggaaggtacgggaacggtacggtaaggttacgggtaaacgttagggggttacggacggggcccggtaacggggg

SEQ ID NO: 266766 - DNA, 551 bp, Homo sapiens
  misc_feature: GYAE6OF01A8J3B.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcgaggtattagaagtatgacgaataacatatattatgacaaactctgtagaagggcagattcaccatctacaggacaattccaagaacacgctagtactcttacaaagtgggacagcctagagagcgtagacggacacggtctagtaatagttacgtggtagggaggagggagacgggtaagttacgggaacgttaggggttggtgggggccgtaacggggg

SEQ ID NO: 266767 - DNA, 561 bp, Homo sapiens
  misc_feature: GYAE6OF01CTNR6.28.57.F02.1.454.CMB.1.raw
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
  modified_base (457)..(457): a, c, t, g, unknown or other
  misc_feature (457)..(457): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattccacctttcagttatttatgctatgcacgtgggtcccgccaggcctccgaggggaagggactggaatatgtctcaggtattagaagtaatgacgaataacatataattangacaaatntgtgaagggnagattcacatcncaggacaatacaagaacacgctagtatcttacaagtgggacagcctgagngcgtgacggacacggctagtatagttacgtggtaggggagaagggacgacgggtaaagtttaggggaaacgttagggggtttacggtgggggtccgaacggggg

SEQ ID NO: 266768 - DNA, 524 bp, Homo sapiens
  misc_feature: GYAE6OF01A42Q7.28.57.F02.1.454.CMB.1.raw
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggagcttggtccagccgtggggggtccctgagactctcctgtgcagcctctggattcaccttcagtatttatgctatgcactgggtccgccaggctcccagggaagggactggaatatgtctcaggtattagaagtaatgacgaataacatatattatgacaaactctgtgaagggtcagattcaccatctaccgaggacaattccaaagacacgctgtatctcaaatgggcagcctgagagctgaggcacggntgtatattacgtggtgggagagggagcggaattggaacgtagggttggtggggccgtaagggg

SEQ ID NO: 266769 - DNA, 557 bp, Homo sapiens
  misc_feature: GYAE6OF01D9C1P.28.57.F02.1.454.CMB.1.raw
  modified_base (381)..(381): a, c, t, g, unknown or other
  misc_feature (381)..(381): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggaaggactggaatatgtctcaggttattagaagtaatgacgaaataacattaatattatgacaaactntagtagaagggcagattacacctatctccgaagggacaattccaaagaacacgctagtatcttacaagtgggacacgcctaggagacgcgtaggaacggacgacggtctaggtattagttacgtggtagggaggaggaggacgaagttggaagttagggttggnggggcgtagggg

SEQ ID NO: 266770 - DNA, 553 bp, Homo sapiens
  misc_feature: GYAE6OF01AKFVS.28.57.F02.1.454.CMB.1.raw
  modified_base (260)..(260): a, c, t, g, unknown or other
  misc_feature (260)..(260): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctntggattcaccttcagtatttatgctatgcactgggtcccgccaggctccgagggaagggactggaatatgtctcaggtattagaagtaatgacgaataacatatattatgacaaactctagtagaagggcagatcacatctcaggacaattccaaagaacacgtctagtactcttacaagtcgggacagcctagagacgctagacggacgacggctagtatagttacgtggtagggaggtaggagtacggaagttagggaacgttaggggttcggtgggggccgtaacggggg

SEQ ID NO: 266771 - DNA, 541 bp, Homo sapiens
  misc_feature: GYAE6OF01DZX9B.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtccgccaggctccgaggggaagggactggaatatgtctcaggtattagaagtaatgacgaaataacatatattatgacaaactctgtagaagggcagattcacatctcaggacaataccaagaacacgctgtatcttacaatgggacagcctaggagagctaggacgacacggctgtatattacgtggtagggagagggaggcggtaagttacgggaacgttaggggttcggtggggccgtaggggg

SEQ ID NO: 266772 - DNA, 529 bp, Homo sapiens
  misc_feature: GYAE6OF01EKEIJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgcgaaataacatatattatgacaaactctgtagaagggcagattcacatctaccaggacaatcaagacacgctgtatctacaatgggcagcctagagagctgaggacacggctgtatattacgtggtggaggaggagacggaagttgggaacgttaggggttgtgggggccgtaacggggg

SEQ ID NO: 266773 - DNA, 553 bp, Homo sapiens
  misc_feature: GYAE6OF01A4O39.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggcctccgaggggaagggactggaatatgtctcaggtattagaagtaatgacgaaataacatatattatgactaaactctagtagaagggcagattcaccatctaccgagggaactaattaccaaagaaccacgtctgtaatcttacaaagtcgggacagcctagagacgcgtgaggacacggctagtatagttcgtggtgggaggaggagacggtaagttggaacgttaggggtggtggggcgaaggggg

SEQ ID NO: 266774 - DNA, 548 bp, Homo sapiens
  misc_feature: GYAE6OF01DX61S.28.57.F02.1.454.CMB.1.raw
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
  modified_base (327)..(327): a, c, t, g, unknown or other
  misc_feature (327)..(327): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagcgtatttaaagtgtcagtgtgaggtgcagctggtggagtcgtgggggaggcttggtccagccgtggggggtccctgagctctcctgtgcagcctntggattcaccttcagtatttatgctatgcactgggtccgccaggctccgagggaagggactggaatntgtctnaggtattagaagtaatgacgaaataanatatattaatcganaaactntgtagaaggacagattcactatctccgaaggacaattcaagacacgtctagtactcttacaagtgggacaagcctagagacgngtacgagacgacgacgtagtagtattacgtggtagggaggaggaggaggtaaggttaggtaaggtagggttagggtggggtcggaacgggg

SEQ ID NO: 266775 - DNA, 523 bp, Homo sapiens
  misc_feature: GYAE6OF01A1XC9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcacatctcaggacaattccaagaacacgctgtatcttcaatgggcagcctgagagctgaggacacggctgtatattacgtggtgggaggaggagcggaagttcgggaacgtaggggttggtgggggtcgacggggg

SEQ ID NO: 266776 - DNA, 621 bp, Homo sapiens
  misc_feature: GYAE6OF01AV0GE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtgggtcccgacgaggcctccgaggggagggactaggaatatgtctcgaggtattagaagtaatgacgaaataacattaatattatgacaaactctaggtagaagggacagtattcccacctatcctaccgaagggaacctaacgttaccaaagaaccacggtcttagttaactctttaacgaaagttcgggacacggaccctaggaacgtacggcggtaggaacgggaacacgggtctaggttaattagttacgtgggtaggggagaagggacggagggttaacgtttagggaacggttaggggttcgggtcggggacgaacggggg

SEQ ID NO: 266777 - DNA, 545 bp, Homo sapiens
  misc_feature: GYAE6OF01BRP73.28.57.F02.1.454.CMB.1.raw
  modified_base (457)..(457): a, c, t, g, unknown or other
  misc_feature (457)..(457): n is a, c, g, or t
  modified_base (471)..(471): a, c, t, g, unknown or other
  misc_feature (471)..(471): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcacctttcagtatttatgctatgcactgggtccgccaggctccgaggggaagggactggaatatgtctcaggtattagaagtatgacgaataacatatattatgacaaactctgtagaaggcagattcaccatctacgaggacaattccaaagaaccacgctagtactcttacaagtggacagcctgagtgntacgaggacacggntagtatagttacgtggtagggacggaggaggacggaagttgggaacgttaggggtcggtggggccgaacggggg

SEQ ID NO: 266778 - DNA, 585 bp, Homo sapiens
  misc_feature: GYAE6OF01E3LAC.28.57.F02.1.454.CMB.1.raw
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagccgtggggggtccctgagactctcctgtgcagcctctggattccaccttcagttatttatgcttatgccacgtcgggtcccgccgaggctccgagggaagggactggaatatgtctcgtaggtattaagaagtatgacgaataacatatattanagacaaactctgtagaagggcagtatccacatcctacgaggaacaacttaccaaagaacacgtctagtactcttagaagtggcagccgtgacgtagcgtagacggaccgacggacttgtaatatttacgtgggtagggaaggagggaggtacgggttaagttacggggtaacgtttaggggttcgggtggggaccggtaacggggg

SEQ ID NO: 266779 - DNA, 583 bp, Homo sapiens
  misc_feature: GYAE6OF01ADQNO.28.57.F02.1.454.CMB.1.raw
  modified_base (490)..(490): a, c, t, g, unknown or other
  misc_feature (490)..(490): n is a, c, g, or t
  modified_base (519)..(519): a, c, t, g, unknown or other
  misc_feature (519)..(519): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattccaccttcagttatttatgtctatgcacgtgggtcccgcgaggctcgagggaaggactaggaatatgtctcgaggtatagaagtatgacgaataacatatatatagacaaactctagtagaggcagtacttcacatcaccgaggactaattccaaagaccacgtctagttactccttaacgaagtgggacctacgtccgtaggagtcgcgtaggacgacgacggtntacgttatacgttacgtgggtaggggaanggggacgtacgggtaagttaggggtaacgttagggggtttcggtacgggggtccggaacggggg

SEQ ID NO: 266780 - DNA, 593 bp, Homo sapiens
  misc_feature: GYAE6OF01DHXEM.28.57.F02.1.454.CMB.1.raw
  modified_base (393)..(393): a, c, t, g, unknown or other
  misc_feature (393)..(393): n is a, c, g, or t
  modified_base (401)..(401): a, c, t, g, unknown or other
  misc_feature (401)..(401): n is a, c, g, or t
  modified_base (418)..(418): a, c, t, g, unknown or other
  misc_feature (418)..(418): n is a, c, g, or t
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggtgtccagtgtgaggtgcagctgggtggagtcgtggggggaggcttggtccaggccgtggggggtccctggagactctcctgtgcagcctctggattcaccttcagttatttatgctatcgctacgtcggggtcccgccgaggcctccggaaggggaacgggacgtagggaattatgtctgtaaggtattaaggaataatgacgaaataacataattatangacaactnagtagaggcagatcacntctcgaggactactacaagaacncgctagtatcttaacgaagtcgggacacgccgtagagtacgcgtaggaacggtacgacggtcttagtaacttagttacggtgggtagggaggtaggacggtagggtaagttacgggaaacggttaggggttggcgggggtacgtaacggggg

SEQ ID NO: 266781 - DNA, 592 bp, Homo sapiens
  misc_feature: GYAE6OF01D5HFX.28.57.F02.1.454.CMB.1.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggcgtatttaaagtagtcagtgtgaggtgcagctggcggagtctgggggaggcttggtccagcctggggggtccctgagactctcctgtgcagcctctggattcacctttcagtatttatgctatgcactggtccgccaggctccgagggaagggactggaatatgtctnaggtattagaagtaatgacgaataanatatatatanacaactcgtgtaggaggacgagtattaccactactcctacgaacggaactaacttaccgaaacgaaccacgtacttagttacttacttaacgaagtcgggacaacgtccgtagaaggtacgcgtaggaacggacgacggtctagttaagttattacggtgggtagggaggtaaggacggtaggtaagttacgggtaacggttaggggttgggtcggggacggacggg

SEQ ID NO: 266782 - DNA, 514 bp, Homo sapiens
  misc_feature: GYAE6OF01ENIDC.28.57.F02.1.454.CMB.1.raw
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (486)..(486): a, c, t, g, unknown or other
  misc_feature (486)..(486): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctggatttcccaggtgttctcatttggtgatcagcactgcacacagaagagtcatgacggagtttgggctgagctgggttttcctgttgctatttttaaaggtgtccagtgtgaggtgcagctggtggagtctgggggaggcttggtccagcctggggggtccctgagactctcctgtgcagcctctggattcaccttcagtatttangctatgcactgggtccncaggctccgagggagggactggaatatgtctcaggtattagaagtaatgacgaataacatatatatgacaaactctagtagaagggcagattacaccatctccaggacaattaccaagaacacgctagtactcttacaaatgggacagcctgagagctgagacnggctgtatattacgngtgggagaggngacggtattaggaagtgggtgngggacg

SEQ ID NO: 266783 - DNA, 1040 bp, Homo sapiens
  misc_feature: GYAE6OF01CLM7F.28.57.F02.1.454.CMB.1.raw
tcagagtacgctatcacgaccggtgctcgatttagctcgatatagttgggtctgggagagggagcccccggccctgggtttcccgaggtgttctcatttggtggatcacgcactgccacgacagaagagtccactgacggacgtttcgggcctgagcgtgggttttccttggttgtcctagttttaaaggtgtccagtgtcgaggtgcagcctggtggagtcgtgggggacggtccttcggtccgacggccggtcggggggtcccctaggacgtaccgtcctcccgtggtcgccgaacggcctccgtagggtactttcctaaccgtttccgtaaggtttaacttttaacttacggttacctttaagttccggtaccgtaacccgtacgggggttccccgtaccccgaaccgggtaccgttaccccggaaaacgggggtaaacccgggtaaccgttacggggtaaaactttaagtttacggttaccgttaaccgttaacgggttaaagttaaacgggtaaacggttaaaccggtaccggtaaccgggtaaaaccttaaaccgtaatttaacgtttaactttaacgttacggtaaccgtaaaacccgtttaccgttaacggttacgggaaacggggtaacccgtaaccgggttaacctttacccccgtaaccccgtaacgttaccccgttaacccggaacggggttaaaccctaaaaccggtttaaccccgaaaaccggaaccccgtaaccgggtaacccgtttaacggtttaaccgtttaacccgtttaacgaaaaacgggtttccggggtaaccttaaccgggttaccccgttagggtaaccggttaccggtaccgttacgggttaaccggtaaccgtttacccgggttacgttaacggttaaacgtttaacggtttaaccgggtcgggggttaacggggtaaacgtaaccggggtaacggtaaccgggttaaacggttaccggggtaaaacggttaccggggggttaacccgggaccgggggtacccggtaaacggggg

SEQ ID NO: 266784 - DNA, 568 bp, Homo sapiens
  misc_feature: GYAE6OF01CA2JB.28.57.F02.1.454.CMB.1.raw
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(180): a, c, t, g, unknown or other
  misc_feature (180)..(180): n is a, c, g, or t
  modified_base (182)..(182): a, c, t, g, unknown or other
  misc_feature (182)..(182): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttcgtgtagctattaagtgcngtntgngncngntgngngtcgngggngctgcagcgtgggtcagnctcnctgngcagcctgtgattcaccttgattattcntntntncncgtcgcgcgcgcgacgaggagagtagtagtagtgtcgtagtagtagtaagtaagtatagtaagaataataataataatagtataactaacgtacgtaggtaggaaggtacgtagtactactactacgtacgtacgaacgtaacgtaactaacgtaacgaacgtacgtacgtacgttactacgtaacgtagtacgacgtacgacgtagacgtacgtacgtacggacgtacgacgtacgtagtacgtagtaggtaggtaggaggaggaggaggtaggtacggtacgggtagggtacgggtggtcggtacggg

SEQ ID NO: 266785 - DNA, 591 bp, Homo sapiens
  misc_feature: GYAE6OF01C9IR3.28.57.F02.1.454.CMB.1.raw
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcacctttcagttatttatgctatgcacgtgggtcccgccaggctccgaaggggaagggactggaatatgtctcaggtaattagaagtaatgacgaaataacataatattangacaaactctgtagaagggcagattcacctatctccaggacaattccaaagaacacgctagtattcttacaaatgggacagccttggagtagctaggacggacgacggcttagtattaacttacgtggtaggggacggtaaggggaggtacgggtaaaggtttacgggaaacggtttagggggtttagggtcggggggtccgtaaacgggggg

SEQ ID NO: 266786 - DNA, 548 bp, Homo sapiens
  misc_feature: GYAE6OF01EPBDX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtccgccaggctccgagggaagggactggaatatgtctcgaggtattagaagtaatgacgaataacatatattatgacaaactctagtagaagggcagtattcaccatctaccgaggacaattaccaagaacacgctagtactcttacaaagtcgggacacgacctgagagcgtagaggacacggctgtatagttacgtggtagggagagggagaggtaagttggaacgtaggggtggtcggggcgtacgggg

SEQ ID NO: 266787 - DNA, 577 bp, Homo sapiens
  misc_feature: GYAE6OF01BNJV7.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgctatgctacgtgggtcccnccgaggcctccgaggggaagggactggaatatgtctcgaggtattagaagtaatgacgaaataacattaatattatgacaaactcgtagtaggaagggcagtacttcacctatcctacgaaggacaacttaccaagaaccacgtactgttactacttacaagtgggacacgcgtagagagactggaacgacgacggactgtacttagttacgtggtagggagagggagtaggtaagttgggaacggttaggggtcggtggggaccgtacgggg

SEQ ID NO: 266788 - DNA, 568 bp, Homo sapiens
  misc_feature: GYAE6OF01BNRUT.28.57.F02.1.454.CMB.1.raw
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtatgcgaataacatatattatgcaaactctgtgaagggcagtatcaccanctcgaggacaattaccaagaacacgctagtatcttacaaagttcgggacacgccgtagaggtagctagagggaccacggctagttactacgtttacgtgggtaggggaaggagggacggtagggtaaacggttgggaaacgttagggggtttggtggggggccgtaacgggggg

SEQ ID NO: 266789 - DNA, 615 bp, Homo sapiens
  misc_feature: GYAE6OF01CVSRQ.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggattccaccttcagttatttatgctatgctacgtgggtcccnccgaggcctccgaagggaaggactaggaatagtgtctacgtaggtattaagaagtaatgacgaaataacataatattatgactaactctagtagaagggcaagtacttacacatcctacgaacggtaactaacttaccgaaagaacccgtaacgctacgtaattacttacgaaagtcgggacagccgtagagtgacgtgaacggacgacggtcttaggtaattacgttacgtagggtagggaacggaagggtaggacggttaagttacgggaaacgttagggggttacgggtgggggacccgtaacggggg

SEQ ID NO: 266790 - DNA, 561 bp, Homo sapiens
  misc_feature: GYAE6OF01EUR5I.28.57.F02.1.454.CMB.1.raw
  modified_base (265)..(265): a, c, t, g, unknown or other
  misc_feature (265)..(265): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttggggtcctgggagaggagcccccgccctgggtttcccaggtgttctcatttggtgatcagcactgcacacagaagagtcagtgacggagtttagggcttgagctgggttttccttgttgctatttttaaaggtgtccagtgtgaggtgcagctgggtggagtcgtgggggagcttggtccagccgtgggggtccctgagactctcctgtgcacgcctntggattcaccttcagtatttatgctatgcacgtggtccgcaggctccgaggggaggactggaatagtgtctcaggtatagaagtatgacgaataacatatacttangacaaactctagtgaaggcagtattccgacatctacgaggacaattccaagaacacgctagtactctacaagtgggacacgcctagagtagctaggacggacgacggcgtagttactactttacgtggtagggtaggagggaggacggaaagttgggaacgttagggttaggtcggggccgtaacggggg

SEQ ID NO: 266791 - DNA, 675 bp, Homo sapiens
  misc_feature: GYAE6OF01CSTG1.28.57.F02.1.454.CMB.1.raw
  modified_base (254)..(254): a, c, t, g, unknown or other
  misc_feature (254)..(254): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgtttcgtcgtaggcgtatttaaagtgtcagtgtgagtgcagctggtggagtcgtgggggagcttggtccagccgtgggggtccctgagctctcctgtgcagtcctntggatttcaccctttatagttattatcgtactagtgtcgtacgtcggtccgccgacgcgtacggagggaacggtacgtaggtaagtagtcgtcgtacgtaggttaagttaagtaagtaagtagtaacgtaaacgtaaactaattaattaattaagtacgtaacgtaaacgtacgtaggtaggtaaggacgtacgtacgtactaccgtactaccgtaccgtaacggtaacgtaactaacgaaacgaacgtacgtactacgttacgttacgttaacgtaacgtacggtacgacgtacgtagtagtacgtacgtacggacggacgtacgtacgtacgtagttagttacggtaggtaggtaggtaggtaggtaggtacggttaacgggtaagggttaggggttacgggtcggggtcgggtacggg

SEQ ID NO: 266792 - DNA, 704 bp, Homo sapiens
  misc_feature: GYAE6OF01E49EE.28.57.F02.1.454.CMB.1.raw
  modified_base (250)..(250): a, c, t, g, unknown or other
  misc_feature (250)..(250): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagcgtattttaaagtgtcagtgtgaggtgcagctggtggagtcgtgggggaggcttgggtccaggccgtggggggtccctgagactctcctgngcagcctctggactcaccttcagttatttatgcttatgccagtcggtcccgcaggcctcgaggggaaggactggaatatgtcctgtaggtattaggaaagtatagacgaaataactattaatattatagactaaacttcgtagtaggaacggctaagattacccaacctacgtacctaccggaacgggtaacctaacgttaccgaaacgaaccgtaccgtcttaacgtacttaccgttaacgtaaacggtcgggaaccgtacggtacccgttaggaacgtaacggtcgtaacgggtaaccggaccggtaccggtaccgtttaggttaaactaagttttaccgggtaggtaaggggttaggaacggggtaccgggtaagggttaaacgggttaaggggtaaaccggggtttagggggtttacggggtacggggggtacccggtaaaccggggggg

SEQ ID NO: 266793 - DNA, 560 bp, Homo sapiens
  misc_feature: GYAE6OF01CKF4M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgaggggaggactggaatatgtctcaggtattagaagtaatgacgaataacatatattatgacaaactctgtagaagggcagattcacatctccgaggacaacttaccaaagaccacgtctagtatcttacaaatgggacagcctgacgagctaggaggacacggctagttatacgtttacgtggtaggggagagggacggtagggtaacgttagggaacgttagggggtttcggtgggggacccgtaaggggg

SEQ ID NO: 266794 - DNA, 522 bp, Homo sapiens
  misc_feature: GYAE6OF01ARNWI.28.57.F02.1.454.CMB.1.raw
  modified_base (487)..(487): a, c, t, g, unknown or other
  misc_feature (487)..(487): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaaggggactggaatatgtctcaggtattagaagtaatgcgaataacatatattatgcaaactctagtgaaggcagattcacatctccaggacaataccaagaacacgctgtatcttacaatgggacagcctgagagctgaggacacggctgtatattacgtggtagggagaggaggngtaagttaggacgttagggttggtggggcgagggg

SEQ ID NO: 266795 - DNA, 533 bp, Homo sapiens
  misc_feature: GYAE6OF01B60EE.28.57.F02.1.454.CMB.1.raw
  modified_base (402)..(402): a, c, t, g, unknown or other
  misc_feature (402)..(402): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtctggggggaggcttggtccagcctggggggtccctgagactctcctgtgcagcctctggattcaccttcagtatttatgctatgcactgggtccgccaggctccagggaagggactaggaatatgtctcgaggtattagaagtatgacgaataacattatattatgactaaactctgtagagggcagattcaccatcncaggacaatccaagaacacgctagtactcttacaagtggcacgctgagagctgagacacggctgtatagttacgtggtgggaggaggagacgggtaagttagggaacgttaggggttgtggggcgtagggg

SEQ ID NO: 266796 - DNA, 686 bp, Homo sapiens
  misc_feature: GYAE6OF01CTO1A.28.57.F02.1.454.CMB.1.raw
  modified_base (308)..(308): a, c, t, g, unknown or other
  misc_feature (308)..(308): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctggagactctcctgtgcagcctctggacttccacctttcagttatttatgctatgctacgtgggtcccnccgaggcctccgaaggggaaggactaggaatagtgtctcgaggttattaaggaagtaatgacgtaaataacattataattatagaactaaactctaggtaggaagggcaggtacttaccgaacctattccgacccgtaagggaacctaacttacccgaaagaacctacgtacttagttaacttaccttaacgtaaaaggttcggggacctaacggtcccgttagggaaggtacgtaccgttagggaacgggtaccgaacgggtcttaaggtaatttaacgttacggtgggtaggggaaggtaagggacgggtaacgggttaaaggtttacggggaaacggtttagggggttcgggtacgggggtacccgtaacggggg

SEQ ID NO: 266797 - DNA, 551 bp, Homo sapiens
  misc_feature: GYAE6OF01BZDHX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggctcggtccagcctggggggtccctgagactctcctgtgcagcctctggattcaccttcagtatttatgctatgcacgtgggtccgccaggctccgagggaaggactggaatatgtctcaggtattagaagtaatgacgaataacatatattatgactaaactctagtagaagggcagtattcaccatcctaccgagggaactaattaccaagaacacgctagtatcttacaagtggcagcctagagacgctaggaggacgacggtctagtatattacgtggtagggaggaggaggacggtaagttaggtaacgttaggggttggtggggcgtacgggg

SEQ ID NO: 266798 - DNA, 585 bp, Homo sapiens
  misc_feature: GYAE6OF01DEZ41.28.57.F02.1.454.CMB.1.raw
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (475)..(475): a, c, t, g, unknown or other
  misc_feature (475)..(475): n is a, c, g, or t
  modified_base (494)..(494): a, c, t, g, unknown or other
  misc_feature (494)..(494): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtcgggtcccgccgaggcctccgagggggaacgggactagggaatagtgtctacgaggttaattagaagtatgacgaataacatatattangacaaactntgtagaaggcagtattccaccatctccgaggacaacttccaaagacacgtctagtactcgtaacaagtgggcaagcctagacgngctaggacggacaacggtntagtatagttacgtgggtagggaggaacgggaggacgggttaaagttacggggtaacggttagggggttgggtccggggcggtaacggggg

SEQ ID NO: 266799 - DNA, 549 bp, Homo sapiens
  misc_feature: GYAE6OF01CSBQY.28.57.F02.1.454.CMB.1.raw
  modified_base (534)..(534): a, c, t, g, unknown or other
  misc_feature (534)..(534): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaaataacatatattatgacaaactctgtagaagggcagattcacatctccgaggacaattaccaagaacacgctagtattctacaatgggcaagcctagagagctggaggacacggtctgtaattattacgtggtagggaggagggagacgggtaagttgggaaacgttaggggtttgggnggggtccgtaagggg

SEQ ID NO: 266800 - DNA, 630 bp, Homo sapiens
  misc_feature: GYAE6OF01D2GYU.28.57.F02.1.454.CMB.1.raw
  modified_base (301)..(301): a, c, t, g, unknown or other
  misc_feature (301)..(301): n is a, c, g, or t
  modified_base (609)..(609): a, c, t, g, unknown or other
  misc_feature (609)..(609): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttcctgttgctattttaaaggtgtccagtgtgaggtgcagctggtggagtcgtgggggaggcttggtccaggccgtggggggtccctgagactctcctgtgcagcctctggattcaccttcagttatttatgctatgcacgtgggtccncgaggctaccgagggaggactaggatatgtctagagtatagaagtatgacgaataacatatatatgactaaactcgtagtagaagggcagattaccacattcctacgaggtaactaacgttacccaaagaacctacgaccttagttacttacctttaacgaaacgtggggacctaaggtcccgttaggaacgtacgtccgtaggaacgggaccgtacggtccttagttaacgttagtttaccggtagggtaggggacgtaagggacgtaccgggtaaagtttcgggaaacgtttaggggggtttcggngggggtacccggtaacggggg

SEQ ID NO: 266801 - DNA, 556 bp, Homo sapiens
  misc_feature: GYAE6OF01EPPCN.28.57.F02.1.454.CMB.1.raw
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggcgtatttaaagtgtcagtgtgaggtgcagctggtggagtcgtgggggaggcttggtccagcctggggggtccctgagctctcctgtgcagcctctggattcaccttcagtatttatgctatgcnctgggtccnccaggctccgaggggaaggactggatatgtctnaggtattagaagtatgacgaataacatatattatgactaaaactctagtagaagggcagtaattcaaccatctacgaggaacaattccaaagacacgctgtatctacaaagtgggacagccgtgacgtagcgtggacgacgaaccggntagttactattacggttggtagggaaggaggtacggaggtaagttagggaaacgttagggttcggtaggggcgtaacgggg

SEQ ID NO: 266802 - DNA, 567 bp, Homo sapiens
  misc_feature: GYAE6OF01AK31Z.28.57.F02.1.454.CMB.1.raw
  modified_base (352)..(352): a, c, t, g, unknown or other
  misc_feature (352)..(352): n is a, c, g, or t
  modified_base (407)..(407): a, c, t, g, unknown or other
  misc_feature (407)..(407): n is a, c, g, or t
  modified_base (495)..(495): a, c, t, g, unknown or other
  misc_feature (495)..(495): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtccgccaggctccgagggaagggactggaatatgtctcgaggtattagaagtaagngacgaataacattaatattatagacaaactctgtaggaaggcagtatcaccatcncgaaggacaattccaagacacgtctgtatcttacaaagtcgggcagcctagacgagctgaacggacacggtctagtattacgttacgngggttaggggacgagggagtaccgggtaattaggggtaacgttaagggggttggtcggggaccgtaaggggg

SEQ ID NO: 266803 - DNA, 763 bp, Homo sapiens
  misc_feature: GYAE6OF01AT8NG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctcgtggattccaccttcagttatttatgctatgctacgtgggtcccgccgaggcctccggaaggggaacgggactagggaatagtgtctacgtaggttattaaggaagttaatgaacgtaaataacattataattatgactaaaactcgttaggtaggaacgggactaaggtactttaccgaaccctagttcccgtacccgaagggtaaacctaaacgtttacccaaaagtaacccacggtacttagttaacttacctttaacgaaagttcggggacaacggtacccgttaggaacggtacggtacgttagggaacgggaccgtaccgggtacgttaggttaaacgtttaacgtttaaccgggttaggggtaacgggggtaaagggtaacgggggtaaacgggttaacccggggttaaaagggttttaacgggggtaaaccgggttttaagggggggttttacggggtaccggggggggtaaaccccgggtaaaccgggggggg

SEQ ID NO: 266804 - DNA, 543 bp, Homo sapiens
  misc_feature: GYAE6OF01EC62W.28.57.F02.1.454.CMB.1.raw
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattccaccttcagttatttatgctatgcacgtcgggtcccgccgaggcctacccgaaggggaagggactaggaatagtgtctcgaggttattagaagtatgacgaaataacatatattatgacaaactctgtagaaggcagtattcacatcacaggacatacaagacacgctgtatctacaagtggacagcctagagacgcgtgaggacacggctagtatattcgnggtagggagnggaagcggtaagttacggaaggttagggtgtcgggcgtaacgggg

SEQ ID NO: 266805 - DNA, 602 bp, Homo sapiens
  misc_feature: GYAE6OF01BM7AV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattccaccttcagttatttatgcttatgctacgtggggtcccgccgaggcctaccgaggggaagggactggaatagtgtctcgaggtattaggaatatgacgaataacatatatatgactaaactctgtagaaggcagtatcacatctacaggacaatccaagacacgtctagtactcttacaagtcgggacaagccctaggacgtagctaggtacggactacgggtacttaggtaaacttacggtttacgtgggttaaggggaggtaacggggaggtacccgggtaaaggtttacgggaacggtttagggggttcggggtcggggaccggtaacggggg

SEQ ID NO: 266806 - DNA, 551 bp, Homo sapiens
  misc_feature: GYAE6OF01E1F1T.28.57.F02.1.454.CMB.1.raw
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggcctccgaggggaagggactggaatatgctcaggtattagaagtaatgacgaataacatatattatgactaaactctgtagaagggcagtattcaccatctccaggaacaattaccaagaacacgctgtatcttacaagtgggcagcctagagagctagacggacacggntagtatattacgtggtagggagaggaggtacgggaaagttacgggaaacgttaggggttggtgggggccgtaacggggg

SEQ ID NO: 266807 - DNA, 603 bp, Homo sapiens
  misc_feature: GYAE6OF01CHRMK.28.57.F02.1.454.CMB.1.raw
  modified_base (374)..(374): a, c, t, g, unknown or other
  misc_feature (374)..(374): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggaagggactgggaatagtgtctcaggttattaagaagtaatgacgaaataacatatattangacaaactctgtagaaggcagtacttcacctatctaccgagggaactaattaccaagaaccacgctagtactcttacaagtcggacagccgtagagacgtcgtagacggaccacggtccgttagtaacgttattaccggtagggttaggggaaggtaggggaagtaccggggttaaaggttcgggtaaacggtttgggggtttacgggtgggggcccggtaaacggggg

SEQ ID NO: 266808 - DNA, 586 bp, Homo sapiens
  misc_feature: GYAE6OF01BMSVC.28.57.F02.1.454.CMB.1.raw
  modified_base (496)..(496): a, c, t, g, unknown or other
  misc_feature (496)..(496): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttgggtccaggccgtggggggtccctgagactctcctgtgcagcctctggattcaccttcagtatttatgctatgcactgggtccgccaggcctccgaggggaagggactaggaatatgtctcgaggtattagaagtaatgacgaataacatataattatagacaaactctagtagaaggcagtatcaccatctaccgaaggacaataccaaagacacgtctgtactcttacaagtcgggacaggtacctggagacgcgtaggacggacgaaccgggtntaggttattaagttacgtgggtaggggagagggaggacgggtaaagttcgggaaacggttaggggttcgggtgggggaccgtaacggggg

SEQ ID NO: 266809 - DNA, 585 bp, Homo sapiens
  misc_feature: GYAE6OF01DJLZP.28.57.F02.1.454.CMB.1.raw
  modified_base (223)..(223): a, c, t, g, unknown or other
  misc_feature (223)..(223): n is a, c, g, or t
  modified_base (296)..(296): a, c, t, g, unknown or other
  misc_feature (296)..(296): n is a, c, g, or t
  modified_base (579)..(579): a, c, t, g, unknown or other
  misc_feature (579)..(579): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccaggggaagggactggaatatgtctcaggtattagaagtaatgcgaataacatatattatgcaaactctgtgaagggcagattcaccatcncaggacaattccaagaacacgctgtatcttcaaatgggcagcctgagagctgaggacacggctgtatattacnggtgggagaggagcggaattggaacgtagggtgtggggcagggcgcccgtggcaccgtctcctcacgcctccgaccgaacgggccccagtccgggtcccttcccccgtggccgccccgtgccctccgacggacgccgaccctccggacgacgccaccgacggccggcccgtacggggcctcggacccgttcgggtaccgaacggtacctaccgttacccagtacgccggttacctcgaggacggtccgggcgttcgggaccgaagggcccgacgtaagtaggnagtgcg

SEQ ID NO: 266810 - DNA, 551 bp, Homo sapiens
  misc_feature: GYAE6OF01ATXE3.28.57.F02.1.454.CMB.1.raw
  modified_base (366)..(366): a, c, t, g, unknown or other
  misc_feature (366)..(366): n is a, c, g, or t
  modified_base (482)..(482): a, c, t, g, unknown or other
  misc_feature (482)..(482): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcaggtattagaagtaatgacgaataacataatattangactaaactctagtaggaagggcaagtattcaccgtatcctaccgagggactaattaccaaagaacacgtctagtatcttacgaatgggcagcctagagagtctagaggacacggntagtatattacgtggtagggagagggagacggaattcgggtaactggggttggtcggggcgtaacgggg

SEQ ID NO: 266811 - DNA, 517 bp, Homo sapiens
  misc_feature: GYAE6OF01D2FX5.28.57.F02.1.454.CMB.1.raw
  modified_base (295)..(295): a, c, t, g, unknown or other
  misc_feature (295)..(295): n is a, c, g, or t
  modified_base (479)..(479): a, c, t, g, unknown or other
  misc_feature (479)..(479): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccnccaggctccgagggaggactggaatatgctcaggtattagagtaatgcgaataacatatattatgacaaactctgtagaagggcagattcacatctacaggacaattccaagacacgctgtatcttcaatgggcagcctgagtgctgaggacacggctgtatattacgtgtagggagtaggagnggaagttggaaacgtaggggttacgtggggcctagggg

SEQ ID NO: 266812 - DNA, 725 bp, Homo sapiens
  misc_feature: GYAE6OF01C2HDD.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagttgggctgagtctgggttttccttgttgtcttattttaaaggtgtccagtgtgaggtgcagctggtggagtcgtgggggaggtcgttggtccgaggccgtggggggtccctggacgtacgtcctcctgtcgcacgcctcgtggacttcctaccttcagtttatttatgtctatcgactacgtcggtccgaccgaggccgtaccggaggggaacgggacgtaggtaatagtgtctacgtaaggttattaagtaagtaagtcgacgaaataacattaataattatagtactaaactcgtaggtaggaacggtcaagtcttaccgaacctacgttaccgaccgaaaggtaaccttaaaccgtccgaaaacggtaccaccggttactagtacttacgttaacgtaaaggtccgggaactacggtccgtaaggacgtacggtacgtagggaacgtacccgtaggtaccttaaggtaaacgttaaccgttaggtaggggtaaggggaacgtaacggggtaaccggtaacggggttaaagttacggggtaaaccgggtttgggggttaccgggggtcgggtacccggggtaaacgggg

SEQ ID NO: 266813 - DNA, 561 bp, Homo sapiens
  misc_feature: GYAE6OF01CSWQ6.28.57.F02.1.454.CMB.1.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
  modified_base (428)..(428): a, c, t, g, unknown or other
  misc_feature (428)..(428): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagcgtatttaaaggtgtcagtgtgaggtgcagctggtggagtcgtgggggaggcttggtccagccgtgggggggtccctggagactctcctgtgcagcctctggattcaccttnagtatttatgctatgcactgggtccnccgaggctaccgagggaggactggaatntgtctnaggtattagagtatgcgaataanatatatactgactaaacgtntaggagaagggcagtacttacaccattccacgagggaactaatacccaagaacncgactgtactctacaagtggacaagccaggagtacgcgtagaacggcaaggtctaggtacttatacgtgggtagggagagggtaggacggtaagttcgggtaagtaggggtttcggnggggtacgtacggggg

SEQ ID NO: 266814 - DNA, 555 bp, Homo sapiens
  misc_feature: GYAE6OF01ASL5S.28.57.F02.1.454.CMB.1.raw
  modified_base (503)..(503): a, c, t, g, unknown or other
  misc_feature (503)..(503): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcaggtattagaagtatgacgaataacatatattatgacaaactctgtagaagggcagtattacaccatcctaccgagggacaattaccaaagaaccacgtctagtactcttacaagtcgggacacgcctagagacgcgtgacggacacggctgtatattacgtggtagggaggnggaggacgggtaattcgggaaacgttaggggttggtgggggccgtaacgggg

SEQ ID NO: 266815 - DNA, 170 bp, Homo sapiens
  misc_feature: GYAE6OF01A2LHA.28.57.F02.1.454.CMB.1.raw
  modified_base (165)..(170): a, c, t, g, unknown or other
  misc_feature (165)..(170): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgggctggcaaggcgcatagnnnnnn

SEQ ID NO: 266816 - DNA, 625 bp, Homo sapiens
  misc_feature: GYAE6OF01BU8XC.28.57.F02.1.454.CMB.1.raw
  modified_base (316)..(316): a, c, t, g, unknown or other
  misc_feature (316)..(316): n is a, c, g, or t
  modified_base (391)..(391): a, c, t, g, unknown or other
  misc_feature (391)..(391): n is a, c, g, or t
tcagagtacgctatcacgaccggtgctcgatttagctcgatatagttgggtcgtgggagaggacgcccccgccctgggtttcccaggtgttctcatttgggtgatcagcactgcacacagaagagtcatgacggagtttgggctgagctgggttttcctttgttgctatttttaaaggtgtccagtgtgaggtgcagctggtcggagtcgtgggggagtcttcggtcccagccgtggggggtcccctggagacctctccgtggtgcagcctcgtggattcaccttcagttatttatgctatgcacgtcgggtcccnccgaggcctccgaggggaagggactaggaatatgtctcgaggtattagaaagtatgacgaaataacatatattangacaaactctgtaggaagggcagtacttcaccatctacgaggaactaattaccaaagacacgtctagtattcttacaagtgggacagcctaggacgtacgtcgtaggaacggaccgacggtacttaggttaaattaagtttaccggtggggttaggggaaggtaagggacggacgggttaaagttaggggtaacggttagggggttttgggacgggggtcccggtaacgggggg

SEQ ID NO: 266817 - DNA, 645 bp, Homo sapiens
  misc_feature: GYAE6OF01CASH3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttgggtcccagccgtggggggtcccctgagactctcctgtgcagcctctggattcacctttcagttatttatgctatgcactgggtcccgccaggctccgaggggaaggggactgggaactagtgtctcgtaggtattaaggaagtaagtgacgtaataacatatattatacgctaaactctgtgaagggcagtattaccacctactctccgagggtacctaacgttacccaaagaccacgtctggtaactccttaacgaaagtcgggacagaccgtaggagtacgcgtaggacggaccgacgggtcttaggtacttaacgtttaccgtagggtttagggggaacggtaggggacgggtaacggggttaagttacgggggtaaaccggttaggggggtttcgggtcgggggggacccggtaacgggggg

SEQ ID NO: 266818 - DNA, 527 bp, Homo sapiens
  misc_feature: GYAE6OF01D53Q0.28.57.F02.1.454.CMB.1.raw
  modified_base (329)..(329): a, c, t, g, unknown or other
  misc_feature (329)..(329): n is a, c, g, or t
  modified_base (479)..(479): a, c, t, g, unknown or other
  misc_feature (479)..(479): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaggactggaatatgtctnaggtattagaagtatgcgaataacatatattatgacaaactctgtagaagggcagattcaccatctaccgaaggacaattccaagaacacgctgtactcttacaaatgggacagcctggagagtctagaggacacgggctgtatattacnggtggagaggagaggaagttggaacgtagggttgnggggcgtaagggg

SEQ ID NO: 266819 - DNA, 578 bp, Homo sapiens
  misc_feature: GYAE6OF01DCIEZ.28.57.F02.1.454.CMB.1.raw
  modified_base (261)..(261): a, c, t, g, unknown or other
  misc_feature (261)..(261): n is a, c, g, or t
  modified_base (331)..(331): a, c, t, g, unknown or other
  misc_feature (331)..(331): n is a, c, g, or t
  modified_base (376)..(376): a, c, t, g, unknown or other
  misc_feature (376)..(376): n is a, c, g, or t
  modified_base (558)..(558): a, c, t, g, unknown or other
  misc_feature (558)..(558): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctgggtggagtctgggggaggcttggtccagcctggggggtccctgagactctcctgtgcagcctcnggattcacttcagtatttatgctatgcactgggtcccgccgaggcctccgaaggggaagggactggaatntgtctacaggtattagaagtaatgacgaaataacattaatattangacaaacttctgtagaagggcagattacacctatctaccgagggacaattacccaagaacacgtctagtatacttacaatgggcagcctgaagagtctgaggaccaggtccgttagattatacgtaggtggggaaggaggtaacgacgggtaaagttcgggaaacggttaggggtttcgggngggggtcccgtaaacggggg

SEQ ID NO: 266820 - DNA, 569 bp, Homo sapiens
  misc_feature: GYAE6OF01EWXRR.28.57.F02.1.454.CMB.1.raw
  modified_base (459)..(459): a, c, t, g, unknown or other
  misc_feature (459)..(459): n is a, c, g, or t
  modified_base (520)..(520): a, c, t, g, unknown or other
  misc_feature (520)..(520): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattccaccttcagtatttatgctatgcactgggtcccgccaggcctccgaggggaagggactggaatatgtctcaggttattagaagtaatgacgaataacataatattatgactaaactctaggtaggaagggcagtattaccaacctatcctaccgaagggacctaacttccaaagaccacgctagtatccttanaaagtgggacagcctagagtgactggagacgacggctagtactattacgtggtaggggagngggaggcggtaaggttacggaacgttaggggtggtggggccgtaagggg

SEQ ID NO: 266821 - DNA, 640 bp, Homo sapiens
  misc_feature: GYAE6OF01CFNE6.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtgggggtcctgagactctcctgtgcagcctcgtggattcaccttcagttatttatgctatgcacgtgggtcccnccgaggcctccgaggggaacggactggaatatgtctgagtattagaatatgagaataacaatatagtatagactaaactctaggtagaagggctaagattaccgactactaccgtacgaacgggaactaacttaaccgaaagaaccacgcttagtaacttaccttaacaaagttcgggactaacgcccgtaggacgtacgaccgtaaggacggtaccgaccgggtacttaggtaaacttaagtttacggtacgggtagggggtaaggaacgggagggtaacggtaaggttacgggtaaacggtttagggggttacgggtagggggacccgtaacggggg

SEQ ID NO: 266822 - DNA, 539 bp, Homo sapiens
  misc_feature: GYAE6OF01D7RYA.28.57.F02.1.454.CMB.1.raw
  modified_base (527)..(527): a, c, t, g, unknown or other
  misc_feature (527)..(527): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactgggaatatgtctcgaggtattagaagtaatgacgaaataacatatattatgacaaactctgtagaagggcagattcacatctaccgaggacaattaccaagaacacgctagtatcttacaaatgggacagcctgagagctgaggacacggctagtatagttacgtgtagggagaggaggcggaagttgggaacgttagggttcggnggggcgaagggg

SEQ ID NO: 266823 - DNA, 705 bp, Homo sapiens
  misc_feature: GYAE6OF01EZXAZ.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgattttagctcgatatagttgggtcttgggtaggaggagcccccgcccctgggtttacccaggtgttctcatttggtgatcagcactggcacgacacgaagagttcatcgaccggagtttgggctgagctggttttccttgttgctatttttaaaggtgtccagtgtgaggtcgcagctggtgggagtcgtagggggaggccttggtccagcccgtcggggggtccctggacgactcgtcctgtgcagcctactggattcaccttcagttatttangctatgcacgtcggtccgccaggctccgagggaggctggatatgtctacaggtacttagaagtactgacgtaatactatagtattactgactaaacttcgttacgtacgaaacggtcaagtacctttacccgacctacttaccgtaccgtaacgggtaacctaaacgttaccgaaagtaacctacggtacgtacgtacttacttaacgtaacggtcggtacctacgtaccgtagtacgtacgtacggacggtaacggaccgtacggtcgttaacggtttagttaacggtttacgggtaggggttaaggggaacggtaacgggacgggttaacggtaaacgggtttaacggggtaaccgggtttaaggggttccgggtaccgggggacccggtaaccggggg

SEQ ID NO: 266824 - DNA, 629 bp, Homo sapiens
  misc_feature: GYAE6OF01B4EQ8.28.57.F02.1.454.CMB.1.raw
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtgggggtcctgagactctcctgtgcagcctcgtggtattcaccttcagtatttatgctatgcactgggtccnccaggctccgagggaaggactggaatatgtctcgaggtattagaagtaatgacgaaataacatatatatgactaaactntagtaggaaagggtcaagtactttacaccctatacctacccgaagggtaacctaaagtttaccaaaagaacccacgtaccttaggttaacttactttaaccgaaagttgggaactacgacccgttagaagtacgccgttaggaacggacgaacggtgttaacttagttacgttaacgttgggtagggaaggtagggacgtacggggaattacggggaaacgttagggggttcggcgggggtccgtaacggggg

SEQ ID NO: 266825 - DNA, 685 bp, Homo sapiens
  misc_feature: GYAE6OF01EI8HU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggacttccaccttcagttatttatgctatgccacgtcgggtcccgccgacggcctaccgaggggaacgggacgtagggaatagttgtctacgaaggttaattaaggaaagtaatggaacgtaaataaactaattaattaattatagaactaaacttcgtaggtaggaagggtcaagtaacttaccaacctattaccgtacccgaagggtaacctaaacttacccgaaaagtaaccacgtacttagttaacttacttaacaaagtcgggacaacggtcctaggaacgtagcgtagggaacggaccgacggtactaggttaacttaagttacggtggggtaggggaaggtaaggggacggtacgggtaaagtttacggggaaacggttagggggtttcgggacggggggtacccggtaacggggg

SEQ ID NO: 266826 - DNA, 521 bp, Homo sapiens
  misc_feature: GYAE6OF01ES8OT.28.57.F02.1.454.CMB.1.raw
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccctgagactctcctgtgcagcctctggattcaccttcaatatttatgctatgcactgggtccgccaggctccgagggaagggactggaatatgtctcaggtattagaagtaatgcgaataaacatataattatgcaaaactctgtgaagggcagatcaccatctccagggacaattccaaagaacacgctagtatcttcaaatgggcaagcctganagctnaggacacggctgtatattacgtgtgggagnggagcggaatggaactagggttgtgggccgaaggg

SEQ ID NO: 266827 - DNA, 562 bp, Homo sapiens
  misc_feature: GYAE6OF01DOZ73.28.57.F02.1.454.CMB.1.raw
  modified_base (559)..(560): a, c, t, g, unknown or other
  misc_feature (559)..(560): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggctggaatatgtctcaggtattagaagtaatgcgaataacatatattatgcaaactctgtgaagggcagattcaccatctccaggacaattccaagaacacgctgtatcttcaaatgggcagcctgagagctgaggacacggctgtatattactggtgggagaggagcggaattagggaacgtaggggttggtggggccgagggacgcccgtggtcaccgtctcctcgacgcctccaccgaacgggcccagtccggtccttcccccgtcggccgccccgtcgcctccgacggacgcccacccgtccgacgacgccacgacgccggcccgtgggcctcggcccgtggtcaacggtacctacttccagtacgtcgtactcgtggacggcgggcgtggaccgaagggccgacgacgtagcnngn

SEQ ID NO: 266828 - DNA, 612 bp, Homo sapiens
  misc_feature: GYAE6OF01DT7QO.28.57.F02.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtgggggaggcttggtccagccgtggggggtccctgagactctcctgtgcagcctcgtggattcaccttcagtatttangctatgcactgggtccncagctccagggatggactggaatatgtctcaggtatagaagtaatgacgaaataactataataattatagacaaaactctagtagaagggcagtattacaccatcctaccaagggtacaacttaccaaacgtaacacgtactacgtaatcttaacgaaagttgggacacggccctgaacgagtctaggacggtaccgacggcgttagtaacttagtttaccgtagggttacggggaaaggtggggaaacggtcgggtaaaggtttacggggaaaccggtttagggggtttagggtacgggggtaacccggg

SEQ ID NO: 266829 - DNA, 643 bp, Homo sapiens
  misc_feature: GYAE6OF01C63QS.28.57.F02.1.454.CMB.1.raw
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtgggggaggcgttgggtccaggccgtcggggggtccctgagacctctcctgtgcagcctcgtggacttcacctttcagttatttatgctatgcacgtcgggtccgccaggcctccgaaggggacggactaggaattagtgtcctagacggttaattaaggaaagtaagtgacgtaaataactaattattattangacaaacttctaggtaggaagggcaggtacttccgaacctattcctaccgaagggtaactaacgttaacccaagtaaccaacgtccttaggttacttactaacgaaagtcggggacaacgtcccgtaaggacgacggcgtaggacgaccgtaggtcctagtacttagttacgtgggtagggaaggaggacgggacggttaaaggttcgggaaacgtttgggggtagtccgggggcgaacggggg

SEQ ID NO: 266830 - DNA, 605 bp, Homo sapiens
  misc_feature: GYAE6OF01EGJIO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtctgggggaggcttggtccagcctggggggtccctgagactctcctgtgcagcctcgtggattccaccttcagttatttatgctatgcacgtcgggtcccgccgaggcctaccgaggggaacgggacgtagggaatagtgtctacgtaggttattaagaagtaatgacgtaaataacataatattatgactaaactctagtaggaagggcagtacttacacctatcctaccgaggaactaacttaccaaagacacgtactagtactcttacaagtcgggacacgtccgtaggagagtctaggacggacgacggtctagttactaagtttacgtgggtagggaaggagggaggacgggtaagttagggaacggttaggggttgggtcggggcggtaacggggg

SEQ ID NO: 266831 - DNA, 555 bp, Homo sapiens
  misc_feature: GYAE6OF01B5OO5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgccaggctccgaggggaagggactgggaatatgtctcaggtattagaagtaatgacgaaataacatatattatgcaaactctgtgaagggcagatcaccatctccgaggacaattccaagaaccacgctgtatcttacaatgggcagcctagagagctggacggacacggctgtatagttacgtggtagggaggtagggacggtacgggaaagtttaggggaaacgttagggggttcgggtcgggggccgtaacgggggg

SEQ ID NO: 266832 - DNA, 639 bp, Homo sapiens
  misc_feature: GYAE6OF01AXK4W.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtgggtcccgccgaggcctccgaggggaacggacgtaggaatagtgtctacgaggttaattaaggaagttaagtgacgtaaataaactattaattaattatagactaaacttcgtaggtaggaagggcaagtacttaccaaccctactcctaccgaagggtaactaacgtaccgaaagaaccacgtctacgtactacttaacgaaagtcgggacacgtaccgtagacgagtcgtaggacggacgacggtctagttattacgttacgtgggtagggaggtagggacgggtacgggtaaagttacgggaacggtttaggggttagggtcgggggtaccgtaacggggg

SEQ ID NO: 266833 - DNA, 656 bp, Homo sapiens
  misc_feature: GYAE6OF01EZDQO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggaggactggaatatgtctcaggtattagaagtaatgacgaataacatatattatgactaaactctagtagaagggcaagtattccaacctatctacccgaagggtaactaaagttaccaaagaacctaacgcttagtaacttaccttaacgaaagtgggacaacgacccgttaggaacgaggtaccgttaggaacgggaccgtaacgggccgttagttaacgttaacgtttaacggtgggttaagggggaagggtaaggggaacgggtaccgggtaaaaggtttacggggaaaccgggtttaaggggtttcggggtacggggggtacccggtaaacggggggg

SEQ ID NO: 266834 - DNA, 769 bp, Homo sapiens
  misc_feature: GYAE6OF01DCHTM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcacgcctcgtggtacttccacctttcagttatttatgctatgctacgtcgggtcccgccgaggccgtaccgaaggggaacgggacgttaggaattagttgtactacgtaaggttaagtttaaggaaagttaagtacggaacgtaaaattaaactaattaagttaatttaatacgaacctaaaacttcgttaaggtagggaaaacggggctaacgtaacttaccgaacctaacgttaccgtaccgaaacgggtaacctaaacgttaacccgaaacgtaaacccgtacgtaccgtttacgttaactttaccgtttaacgtaaaggttacgggaactaacggtaccgtaggaacggtacggtacgtacggtaacgggtaccggaacggtaccgttagttaacgttaacgtttacggttacgggtagggggaacggtaaggggtaagggtacgggttaaacggtttacggggtaaacggtttagggggttacgggtacgggggacccggtaacggggg

SEQ ID NO: 266835 - DNA, 561 bp, Homo sapiens
  misc_feature: GYAE6OF01BE0FY.28.57.F02.1.454.CMB.1.raw
  modified_base (376)..(376): a, c, t, g, unknown or other
  misc_feature (376)..(376): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggattcaccttcagttatttatgctatgcactgggtccgccaggctccgagggaaggactggaatagtgtctcgaggtattagaagtatgacgaataacatatattatgacaaactntgtagaaggcagattcactatctacgaggacaacttacaagacacgtctagtatcttacaagtgggacagcctagagacgcgtagacggacacgggctaggtaacttagttacgtggtggggaaggagggaggtacgggtaagttagggaaacggtttggggtaggtcggggccggtaacggggg

SEQ ID NO: 266836 - DNA, 560 bp, Homo sapiens
  misc_feature: GYAE6OF01EVEIL.28.57.F02.1.454.CMB.1.raw
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgtagcctctggattcaccttcagttatttatgctatgcactgggtccgccaggcctccgaggggaagggactgggaatagtgtctcgaggtattaagaagtatgacgaataacataatattatgacaaactctgtagaaggcagtattcacctatctacgaggactaataccaagaccacgctagtatcttacaatggacngcctagacgngctgaggacacggctagtattattacgtggtgggaggagggaggacggtaagttagggtaacggttaggggttagggtcgggggccgaggggtaccgg

SEQ ID NO: 266837 - DNA, 538 bp, Homo sapiens
  misc_feature: GYAE6OF01EI3UF.28.57.F02.1.454.CMB.1.raw
  modified_base (297)..(297): a, c, t, g, unknown or other
  misc_feature (297)..(297): n is a, c, g, or t
  modified_base (480)..(480): a, c, t, g, unknown or other
  misc_feature (480)..(480): n is a, c, g, or t
  modified_base (528)..(528): a, c, t, g, unknown or other
  misc_feature (528)..(528): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaggactggaatatgtctcaggtattagaagtatgcgaaataacatatattatgactaaactctagtagaagggcaagattacaccatcctaccagggacaattaccaaagaacacgtctagtactacttacgaaatgggacacgcctagagagcgtagacggacacggntgtatattacgtggtggagaggagcggaattcgggaactagggttggngggcgagggg

SEQ ID NO: 266838 - DNA, 578 bp, Homo sapiens
  misc_feature: GYAE6OF01CE8SE.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcacgtgcacacagaagagtcatgacggagtttgggctgagctgggttttccttgttgctattttaaaggtgtccagtgtgaggtgcagctggtggagtcgtgggggaggcttggtccagcctggggggtccctgagactctcctgtgcagcctctggattcaccttcagtatttatgctatgcactggggtccgccaggctccgaggggaaggactggaatatgtctcaggtattagaagtaatgacgaaataacatatattatgacaaactctagtagaagggcaagtattaccaccatcctaccgaagggaactaacttaccaaagaaccacgtcttagtacttcttacaaagtggacaagcctaggagtagctagggagacgacggtctagtatagttacgtggtagggaggtagggagacgggtaaattgggaaacgttaggggttaggtcgggggaccgtaacgggg

SEQ ID NO: 266839 - DNA, 551 bp, Homo sapiens
  misc_feature: GYAE6OF01CEVPF.28.57.F02.1.454.CMB.1.raw
  modified_base (253)..(253): a, c, t, g, unknown or other
  misc_feature (253)..(253): n is a, c, g, or t
  modified_base (333)..(333): a, c, t, g, unknown or other
  misc_feature (333)..(333): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgatggagtttgggctgagctgggttttccttgttgctattttaaaggtgtcagtgtgaggtgcagctggtggagtcgtgggggaggcttggtccagccgtggggggtccctgagactctcctgtgcngcctctggattcaccttcagttatttatgctatgcacgtgggtccgccaggctccgagggaagggactggaatatgtctnaggtattagaagtatgacgaataacatatattatgactaaactctagtagaagggcaagtattcaccatcctacgaagggactaacttaccaagaacacgcttagtactacttacaaagtgggacagccgtgacgagcgtgacggacgcggntagtattagttacgtggtagggagaggagacggtaagttagggaagttgggtgggtggggtaccgg

SEQ ID NO: 266840 - DNA, 529 bp, Homo sapiens
  misc_feature: GYAE6OF01A83NR.28.57.F02.1.454.CMB.1.raw
  modified_base (297)..(297): a, c, t, g, unknown or other
  misc_feature (297)..(297): n is a, c, g, or t
  modified_base (456)..(456): a, c, t, g, unknown or other
  misc_feature (456)..(456): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaagggactggaatagtgtctcaggtattagaagtaatgacgaataacatatattatgcaaactctgtagagggcagatcacatctccaggacaattacaagaacacgctgtatcttacaatgggcagcctgagagctagaggacncggctgtatattacgtggtgggaggagggagaggaagttaggaacgttaggggttggtggggccgtaacgggg

SEQ ID NO: 266841 - DNA, 628 bp, Homo sapiens
  misc_feature: GYAE6OF01D156P.28.57.F02.1.454.CMB.1.raw
  modified_base (175)..(175): a, c, t, g, unknown or other
  misc_feature (175)..(175): n is a, c, g, or t
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtctgggggaggcttggtccagcctggggggtccctgagactctcctgtgcagcctctggattcaccttcagtatttangctatgcacgtgggtccgccaggcctaccgaggggaagggactggaatatgtctcgaggtattagaagtatgacgaataacatattagttatgactaaacttcgtagtaggaaacgggcagtacttacaccattccgtaccgaagggtaactaacttaccgaaagtaccacgtcctagttactcttacaaagtcgggacacggtcctaggacgtacgtcgtaggaacgggacgtaccgggtctagttagttacgttacggtagggtaggggaaggaacgggtaaggtaccgggtaaagtttcgggtaaacggttagggggtttagggtccgggggtcgaaacgggggg

SEQ ID NO: 266842 - DNA, 604 bp, Homo sapiens
  misc_feature: GYAE6OF01DP34H.28.57.F02.1.454.CMB.1.raw
  modified_base (303)..(303): a, c, t, g, unknown or other
  misc_feature (303)..(303): n is a, c, g, or t
  modified_base (395)..(395): a, c, t, g, unknown or other
  misc_feature (395)..(395): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattcaccttcagttatttatgctatgcactggggtcccnccgaggctccgaggggaagggactggaatatgtctcgagtattagaagtaatgacgaataacatatattatgacaaactctaggtgaagggnagtattacacctatctaccgaagggtaacaactttaccaaacgaaccacgtactagttaactaccttacaaagtcgggacacgccgtagagacgacgtacggaaggaccgacggtcgtagtattaagttacgtggtaggggaaggagggaaggtacggtaaagtttacgggaaacggttaggggttacgggtgggggccgtaacggggg

SEQ ID NO: 266843 - DNA, 618 bp, Homo sapiens
  misc_feature: GYAE6OF01EZK3R.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctggagactctcctgtgcagcctctggattcaccttcagttatttatgctatgcacgtgggtcccgccgaggcctccggaaggggaagggactaggaatatgtctacaggtattagaagtatgacgaataacattatattatagactaaactcgtaggtaggaagggacaagtacttaccaacctagttccgtaccgaagggtaacctaacgttaccaaacgaacctacgtcttagttacttcgttactaaagtgggacacgcctaggacgagacgtaggacggaccgacggtcttagtacttagttacgtggtagggaaggagggaggacggtaagttacgggtaacggttaggggttcgggtcggggcggtaacgggg

SEQ ID NO: 266844 - DNA, 707 bp, Homo sapiens
  misc_feature: GYAE6OF01EG7W9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgctatgcacgtcggggtcccgccaggcctaccggaggggaagggactaggaatagtgtctacgaggttattaagaagtatgacgtaaataacattatattatgactaaactctgtagaaggcagtacttaccacctatccgtaccgaagggaacctaacgttaccgaaagtaaccacgtacttagttacttaccttaacgaaacggttcggggactacggtacccttaagggaacgtacggtacgttacgggaacgggaacccgacgggtaccttagggttaaacttaacgttttaaccgggtaggggttaaggggaacggggtaacggggtaacgggtaaccggggttaaaggtttacggggtaaaaccgggtttaggggggtttacgggggtacgggggggtaacccggtaaacggggggg

SEQ ID NO: 266845 - DNA, 535 bp, Homo sapiens
  misc_feature: GYAE6OF01A6BM4.28.57.F02.1.454.CMB.1.raw
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtatgacgaataacatatattatgacaaactctgtgaagggcagattcacatctcgaggacaattccaaagacacgctagtatcttanaatgggacagcctgagagctgaggacacggctagtatagttacgtggtagggagagggagacggtaagttgggaacgttaggggttggtcgggggccgaggggg

SEQ ID NO: 266846 - DNA, 573 bp, Homo sapiens
  misc_feature: GYAE6OF01DQJVC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcaccttcagttatttatgctatgcacgtgggtccgccaggcctccgaggggaagggactggaatatgtctcaggtattagaagtaatgacgaataacattaatattatgacaaactctagtaggaagggcagtattccaccatcctcgaaggacaacttaccaaagaacacgctagtactcttacaagtggacacgcctaggagagctagggacggacgacggctagtacttagttacgtggtagggaggagggaggacggtaaggttcggtaaacggttaggggttgggtcggggcgaacggggg

SEQ ID NO: 266847 - DNA, 664 bp, Homo sapiens
  misc_feature: GYAE6OF01DNZQ9.28.57.F02.1.454.CMB.1.raw
  modified_base (394)..(394): a, c, t, g, unknown or other
  misc_feature (394)..(394): n is a, c, g, or t
  modified_base (432)..(432): a, c, t, g, unknown or other
  misc_feature (432)..(432): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtggttttccttgttgctattttaaaggtgtccagtgtgaggtgcagctggtggagtcgtgggggaggcttggtccagccgtggggggtccctgagactctcctgtgcacgcctcgtggacttccaccttcagttatttatgtctatcgcacgtcgggtcccgccgaggcctaccggaaggggaaggtcgtaggaatagtgtctacgtaggtataagaagtatagacgtaaataacaattataattangactaactgtagtaggaggacaagtacttaccaacctntccgtaccgaaggtaactaactaccgaaagaaccacgtctagtacttactacgaagtcgggactcgaccgtaggaacgtacgccgtaaggaacggacgtaccggtacttagttacttaacgtttacggtaggggtagggtaagggtacggggaagggttaacggttaaacgggttaacggggtaaacgggtttggggggtttacgggacggggggtaccggtaaccgggggg

SEQ ID NO: 266848 - DNA, 528 bp, Homo sapiens
  misc_feature: GYAE6OF01AVU81.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtatagaagtaatgcgaataacatatattatgcaaactctgtagaagggcagatcacatctccaggacaattccaagacacgctagtatctacaagtggcagcctgagagctgacgacacggctgtatagttacgtggtagggaggaggagacggtaagttgggaacgttaggggttggtggggccgtaacgggg

SEQ ID NO: 266849 - DNA, 684 bp, Homo sapiens
  misc_feature: GYAE6OF01DY1W2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtcgggtcccgccgacggccgtaccgaaggggaagggactagggaatagtgttactcgtaaggttaagttaagtaagtaatgaacgtaaataaacattaataattagtgaactaaacgtcgtaggtaggaaagggtcaagtactttaccgaacctacgtccgtaccgaaagggtaacctaacgttaccaaacgtaaccgaccgtacttagttaacttaccttaacgtaaagtcgggacacggtacctaggacgtagtaccgtaggaacggacgacggtacttacgtaattacgtttaacggtgggttaggggaaggtaagggacgggtaacgggttaaacggttagggtaaacggttaggggtttacggggtccggggtacggtaacggggg

SEQ ID NO: 266850 - DNA, 595 bp, Homo sapiens
  misc_feature: GYAE6OF01ADHYF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtcccgccaggctccgagggaagggactggaatagtgtctacgaggtattaggaagtaatcgacgtaaataacatatattatgacaaactcgtagtagaagggcagtacttacacctactcctaccgaacgggactaacttaccgaaagaaccacgtactagtactcttaacgaagtcgggactacggcctaggagacgtcgttaggaacggacgtacggcttagtactagttacgtcgggtaggggaggagggaggacggtagttacgggaacgttaggggttcggtcggggcgtacgggg

SEQ ID NO: 266851 - DNA, 570 bp, Homo sapiens
  misc_feature: GYAE6OF01AV3OC.28.57.F02.1.454.CMB.1.raw
  modified_base (300)..(300): a, c, t, g, unknown or other
  misc_feature (300)..(300): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtccnccaggctccgagggaagggactggaatatgtctcaggtattagaagtatgacgaaataacatatattatgacaaactntgtagaaggcagatcacctatcctacaggaactaattaccaaagaccacgtctagtactcttacgaaagttcgggacaacggcctaggagtacgcgtaggacgggacacggtctagtaacttattacgtggtagggagagggtacgagggtaagttagggaacgttaggggttcggtgggggccgtaagggg

SEQ ID NO: 266852 - DNA, 719 bp, Homo sapiens
  misc_feature: GYAE6OF01D8SH2.28.57.F02.1.454.CMB.1.raw
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtggggggtccctgacgactctcctgtgcagcctctggtattcaccttcagttatttatgtctatgctacgtgggtcccgcgagggcctccggaggggaacgggacgtaggaatagtcgtctacgtaggttagttaagaagtatagacgaaataacatatatatgactaactntgtaggaagggctaagtacttcaactactccgtacgaacgggtaacaaaccgttaccgaaacgaacctaccgtacgttacgttaacgttacctttaaacgtaacggtacgggtaccgaacggttccctaacgggagtaaccggtacggtaaggaaccgggtaaccgtaccgggtacgttacggttaacgttaacgtttaccggtaggggttaggggtaacgggtaacggggtaacgggtacggggttaaacggtttaacggggtaacggggtttaagggggggtttacggggtaccgggggtaaccgggtaaccgggggg

SEQ ID NO: 266853 - DNA, 701 bp, Homo sapiens
  misc_feature: GYAE6OF01DL7BV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggcttggtccagccgtggggggtccctgagactctcctgtgcagcctctggattcaccttcagttatttatgctatcgcacgtcgggtccgccgaggcctccgaggggaggactggaatatgtctacgaggttattagaagtatgacgtaaataacattaattattatacgactaaacttcgtaggtaggaagggcaagtacttaccgacctaatccgtaccgaagggaactaaacttaccgaaacgaaccacgtacttagtacttacctttacgaaacgtgggacctaaggtacccgttaggaacgtacggtcgttacgggaacgggaccgtacgggtaccgttaaggttaaactttaacgtttaccggttaggggttagggggaagggtaaggggtaacggggtaaccgggttaaaggtttacgggggtaaacgggtttaggggggttttacggggtaccggggggtacccggtaaacggggggg

SEQ ID NO: 266854 - DNA, 591 bp, Homo sapiens
  misc_feature: GYAE6OF01CMLQY.28.57.F02.1.454.CMB.1.raw
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagctgggttttccttgttgctattttaaaggtgtccagtgtgaggtgcagctgggtggagtcgtgggggaggcttggtccagccgtggggggtccctgagactctcctgtgcagcctctggattccacctttcagttatttatgctatgcacgtggggtcccnccgaggcctccgaggggaacggactgggaatatgtctcgaggtattaagaagtaatgacgaaataacatatattangacaaactntgtagaagggcagattcacctatctacgaaggacaattaccaagaaccacgcttagtacttacttacaaagttgggacaagtccctaggagagcgtaggacggacacgggcttagtattagttacgtgggttaggggaggtagggaaggtacggtaaagttcggggaaacgttgggggttcggtgggggcccgtaaaggggg

SEQ ID NO: 266855 - DNA, 726 bp, Homo sapiens
  misc_feature: GYAE6OF01D9Z3M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctccgtgtgcagcctctggattcaccttcagttatttatgctatcgctacgtgggtcccgccgaggcctccggaaggggaacgggtactaggaattagtcgttctacgtaaggttattaaggaaagttaagtaggaacgtaaaataaactaattaattaatttatacgtaactaaaaccttcgttaggtaggaaagggtcctaagtaacttaccaacctagttacccgtaaccgaagggtaacctaactttacccgaaaagaaccgtacgtacttagttaacttaccgtttaacgaaagttcggggaacctacggtacccgttaggaacgggtacgacgttaacgggaaccggtaaccggtaccgggtacttacggttaaagttaacgtttaacggtggggttaacggggaaggtacggggtaacggtacggtaaagttacgggtaacggttaggggttcgggtacggggacggtaacgggg

SEQ ID NO: 266856 - DNA, 530 bp, Homo sapiens
  misc_feature: GYAE6OF01A8XKF.28.57.F02.1.454.CMB.1.raw
  modified_base (470)..(470): a, c, t, g, unknown or other
  misc_feature (470)..(470): n is a, c, g, or t
  modified_base (489)..(489): a, c, t, g, unknown or other
  misc_feature (489)..(489): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgccaggctccgagggaaggctggaatatgtctcaggtattagaagtaatgacgaataacatatattatgacaaactctgtagaagggcagtattcacctatctccagggaccaattaccaaagtaaccacgctagtatccttacaagtgggcagcctgagagctgagacgacggntgtatatacgtggtggagnggagcggaattgggaacgttagggttggtggggccgagggg

SEQ ID NO: 266857 - DNA, 540 bp, Homo sapiens
  misc_feature: GYAE6OF01AUMX2.28.57.F02.1.454.CMB.1.raw
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtccgccaggctccgagggaaggactggaatatgtctcaggtattagaagtatgacgaataacatatattatgacaaactctagtagaaggcagtatcaccatctcgaggacaattaccaaagaacacgctagtatcttacaaagtgggacagcctagagtagctgaggacncggntagtatattacgtggtagggagaggacgaggaagttgggaacgttaggggttggtggggacgtacgggg

SEQ ID NO: 266858 - DNA, 560 bp, Homo sapiens
  misc_feature: GYAE6OF01C40OJ.28.57.F02.1.454.CMB.1.raw
  modified_base (306)..(306): a, c, t, g, unknown or other
  misc_feature (306)..(306): n is a, c, g, or t
  modified_base (400)..(400): a, c, t, g, unknown or other
  misc_feature (400)..(400): n is a, c, g, or t
  modified_base (442)..(442): a, c, t, g, unknown or other
  misc_feature (442)..(442): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
  modified_base (512)..(512): a, c, t, g, unknown or other
  misc_feature (512)..(512): n is a, c, g, or t
  modified_base (521)..(521): a, c, t, g, unknown or other
  misc_feature (521)..(521): n is a, c, g, or t
  modified_base (548)..(548): a, c, t, g, unknown or other
  misc_feature (548)..(548): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtgggggagcttggtccagccgtggggggtccctgagactctcctgtgcagcctcgtggattccacctttcagttatttatgtctatgcacgtgggtcccnccgaggcctccgaggggaacggactaggaatatgtctcgagtaatagaatatgacaataacattatatatgactaaactcgtagtagaacgggntaagtactcacatcctacgaggtaacataaccaagactacgntacgtattactaacaagtcggacacgtccgagaagngtacgtggaacgacgcgtntagtaatgttaacgnggagggagnggacgagtaagtcggtaagtgggtggngggaccgtaggg

SEQ ID NO: 266859 - DNA, 589 bp, Homo sapiens
  misc_feature: GYAE6OF01A7W2R.28.57.F02.1.454.CMB.1.raw
  modified_base (370)..(370): a, c, t, g, unknown or other
  misc_feature (370)..(370): n is a, c, g, or t
  modified_base (516)..(516): a, c, t, g, unknown or other
  misc_feature (516)..(516): n is a, c, g, or t
  modified_base (534)..(534): a, c, t, g, unknown or other
  misc_feature (534)..(534): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtctgggggagcttggtccagccgtggggggtccctgagactctcctgtgcagcctcgtggattcaccttcagtatttatgctatgcactgggtccgccaggctccgagggaaggactggaatatgtctcaggtattagaagtaatgacgaaataacattatattangacaaaactctgtaggaaagggcaagtattcaaccgatctaccgaaggacaaacttccaaagacacgctagtatcttacaaagtcgggctaacggcccttaggaagagccgttagaacggacaacgggctaggtaattattacggnggtaggggaggaacgganaccgggtaaagtttgggaaacggtttaggggttcggtcgggggcctaaacggggg

SEQ ID NO: 266860 - DNA, 731 bp, Homo sapiens
  misc_feature: GYAE6OF01C3O1S.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctcgtggattcacctttcagttatttatgtctatgcacgtgggtccgcgaggctccgaggggaacggacgtggaatatgtctcgaggtataggtaagtaatgacgtaaataacgtatattaattagtagactaaaactctaggttaggaaacgggactaggtaacttaccaacctacgttaccgtacccgaaggggtaaacccttaaacgttacccaaaaggtaaccccgaacggtacctttaacggttaactttaccgttaaccgtaaaaggttcgggggaacctaacggtccccgttaaggaacggtacgtaccggttgggaaaccggaaccgtacgggaccgtttagtaaacgttaacgtttacgggtacgggttaggggtaagggagggaacgggaacgggtttaaaggttacggggtaaaacgggttaggggggtttacggggtccggggggtaccgggtaaacgggggg

SEQ ID NO: 266861 - DNA, 517 bp, Homo sapiens
  misc_feature: GYAE6OF01DY8UO.28.57.F02.1.454.CMB.1.raw
  modified_base (365)..(365): a, c, t, g, unknown or other
  misc_feature (365)..(365): n is a, c, g, or t
  modified_base (418)..(418): a, c, t, g, unknown or other
  misc_feature (418)..(418): n is a, c, g, or t
  modified_base (478)..(478): a, c, t, g, unknown or other
  misc_feature (478)..(478): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtatagaagtatgacgaataacatatattangacaaactctgtagaagggcagattcacatctcaggacaatcaagacacgctntatacttacaagtggcagctagagagcgtgaggacagctgtatagtacgtggtagggagnggagcggaagttggaacgttagggtgtgggccgtagggg

SEQ ID NO: 266862 - DNA, 536 bp, Homo sapiens
  misc_feature: GYAE6OF01EM8V3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggctggaatatgtctcaggtattagaagtaatgacgaataacataatattatgactaaactctagtagaagggcagattcaccatctccaggacaatccaagaacacgctgtatctacaatgggacagcctgagagctgagacacggctagtatattacgtggtagggaggaggagacgggtaaagttgggaaacgttaggggttggtgggggcgaacgggg

SEQ ID NO: 266863 - DNA, 613 bp, Homo sapiens
  misc_feature: GYAE6OF01DFRTW.28.57.F02.1.454.CMB.1.raw
  modified_base (379)..(379): a, c, t, g, unknown or other
  misc_feature (379)..(379): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggtttttccttgttgcttatttttaaaggtgtccagtgtgaggtgcagctggtggagtcgtgggggagcttggtccagccgtggggggtccctgagactctcctgtgcagcctctggattcaccttcagttatttatgctatcgcacgtgggtccgccgaggctccgaggggaagggactggaatatgtctacgaggtattaagaagtaatgacgaataacatatattangacaactctagtagaaggcagtacttcacctatctaccgaggactaacttaccaagaaccacgtacttagtacttactttaanaagttcgggacagccgtagacgngcgtaggacggaccgacggtcttagtaattacgttacggtgggtaagggaggaaagggtacggtaaggtaaacgggtttacgggaaacggtttagggggttacgggtcgggggtccggtaaacggggg

SEQ ID NO: 266864 - DNA, 615 bp, Homo sapiens
  misc_feature: GYAE6OF01CZUOD.28.57.F02.1.454.CMB.1.raw
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggtccagccgtggggggtccctgagctctcctgtgcagcctctggattccaccttcagttatttatgctatgcacgtgggtcccnccgaggcctccgaggggaaggactaggaatatgtctcaggtattaagagtaatgacgaaataacattataacttanagacaaacttctagtaggaaggcagtacttcaaccattccacgaaggacctaattccaaagaacncgtacttagtattacttacgaaagtcgggacacgtcctaggagacgtcgtaggaacgacgacggtacttaggtaatttaacgtacgtgggtagggaggttaaagggcggtaacggtaaggtttacggggtaaacgtttaggggggttcggtcgggggaccgtaacgggggg

SEQ ID NO: 266865 - DNA, 532 bp, Homo sapiens
  misc_feature: GYAE6OF01AJ6ZA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactgggaatatgtctcaggtattagaagtaatgacgaataacatatattatgacaaactctgtgaagggcagatcacatctccagggacaattccaagaacacgctagtatcttacaatgggcagcctgagagctgaggacacggctgtatattacgtggtgggaggagggagacggtaagttagggaacgttaggggttggtgggggcgtagggg

SEQ ID NO: 266866 - DNA, 626 bp, Homo sapiens
  misc_feature: GYAE6OF01AG8YV.28.57.F02.1.454.CMB.1.raw
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (383)..(383): a, c, t, g, unknown or other
  misc_feature (383)..(383): n is a, c, g, or t
  modified_base (405)..(405): a, c, t, g, unknown or other
  misc_feature (405)..(405): n is a, c, g, or t
  modified_base (486)..(486): a, c, t, g, unknown or other
  misc_feature (486)..(486): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcncgcctnggattccacttctagtatttatgcttatcgcacgttcgggtcccgcgaggcctccgaaggggaagggtctaggaattatgtctcgtaggtattaagaagtatgacgaatacagttatattangactaaatcgtagtaggacgtnagtacttcactagtcctacgaaggtactaacgtacaaacgacgtacgtctagtactagttacaaggtcggactacgtaccncggaagtacgcgttaacggacggacgaccggtgttaattacgttattaggtgggtaacgggaagggtaggaacgggtaagggttaacgttaacgggtaaggtttaagggggttcgggtacggggggacgtaaccgggggg

SEQ ID NO: 266867 - DNA, 652 bp, Homo sapiens
  misc_feature: GYAE6OF01CO7FT.28.57.F02.1.454.CMB.1.raw
  modified_base (536)..(536): a, c, t, g, unknown or other
  misc_feature (536)..(536): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagctctggattcaccttcagtatttatgctatgcacgtgggtcccgccaggcctccgaggggaaggactaggaatagtgtctcgaaggttattaagaagttagtagacgaaataacatataattatagactaaactcgtagtagaagggcaagtacttcaacctatcctacgaagggaactaaacttacccaaagaaccacgtactagttactacctttacgaaagttcggggacaacggtcccgtaggaaggacgtacgtagggaacgggacgaaccgggtnttaggtaatttaacgttacggtagggtacggggaaggtaaggggtacggacgggttaaaggtttcgggtaaaaggtttagggggtttcggggtacgggggtcccgtaaacgggggg

SEQ ID NO: 266868 - DNA, 854 bp, Homo sapiens
  misc_feature: GYAE6OF01DIR5B.28.57.F02.1.454.CMB.1.raw
  modified_base (707)..(707): a, c, t, g, unknown or other
  misc_feature (707)..(707): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagcttgggttttccttgttgcttatttttaaaggtgtccagtgtggaggtgcgagtcgtgggtggtagtcggtgggggacgtcgttcggaccgacggtccgggtccgggggtccctggacgtaccttccgttccgtcggtgaccgacgtccctcgtggtactttcctaccttacgtaagtttaatttagtcgtacttagtcgaccgtacgggttccgggttacccgaccggtacggtcccgttaacggggaagggggaacggtacggtaaggtaattagttcgtacctaaggtaaggtttaagtaaaggtaaagtaacgtacggtaaactaaaacttaaactaattaatttaacttaagtaccgaaaccttaaacgttggttaggtaagggtaaaccggacggtaaagttaccttaaccctaaacccgttaccgtaccgtaaccgggtaaaccggtaaaaccttaaccttaaacggaaaaacccgtaacccgtacgttacggttaagtttaccctttacgtaaacgttaacgggccggtacgaacctacggttagaaggtacncggtaaggtaacccggacggtaccgtagtttacgtacgtttaaacgttcgggtaggggtaacgggagggtacgggaaacgggtagggtttaaacgtcggggttaaaacggggtttgggtcggggtaaccgggcgggtaaacccgggg

SEQ ID NO: 266869 - DNA, 597 bp, Homo sapiens
  misc_feature: GYAE6OF01AOUFV.28.57.F02.1.454.CMB.1.raw
  modified_base (325)..(325): a, c, t, g, unknown or other
  misc_feature (325)..(325): n is a, c, g, or t
  modified_base (349)..(349): a, c, t, g, unknown or other
  misc_feature (349)..(349): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (481)..(481): a, c, t, g, unknown or other
  misc_feature (481)..(481): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtggtccgccaggctccgagggaaggctggaatntgtctcgaggtattagaagtatgngaatacatatatatgacaactctgtagagggcagtattcacntcncgaggacaataccaaagaccacgctagtatccttacaagttcgggctacgacctaggacgtacgcgtaggaacggtaccgaccggtnttaggttaagttaactttacggtgggttagggggaacggtagggggtaagtacgggttaaagtttacggggaacggtttaagggggtttgggtacggggggtaccgtaacgggggg

SEQ ID NO: 266870 - DNA, 630 bp, Homo sapiens
  misc_feature: GYAE6OF01CMBGS.28.57.F02.1.454.CMB.1.raw
  modified_base (307)..(307): a, c, t, g, unknown or other
  misc_feature (307)..(307): n is a, c, g, or t
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtgggggggtccctgagactctcctgtgccagcctctggattccacctttcagttatttatgctatgcacgtgggtcccnccgaggctccgagggaaggactggaatatgtctacgaggtataaggaagtaatgacgtaataacatataattangactaaactctaggtagaagggactagacttacaccactctacccgaaggactaacttaccgaaagaaccacgtctagtattacttacaaagttcgggacacgtacccgtaggaacgtacgcgttagggaacgaccgacgggtctagtacgttaagttacgtgggtagggaacggtagggacggtaacgggttaaggttacgggtaacggttagggggttcggggtaccgggggtacgggtaacggggg

SEQ ID NO: 266871 - DNA, 583 bp, Homo sapiens
  misc_feature: GYAE6OF01DVBGY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttgggtccagccgtggggggtccctgagactctcctgtgcagcctctggattcaccttcagttatttatgctatgcacgtgggtccgccaggctccgaggggaaggactggaatatgtctcgaggtattagaagtatgacgaataacatatattatgacaaactctgtagaagggcagattcaccatctaccaggacaacttaccaagacacgctagtattcttacaagtgggacagcctagagtacgcgtaggacggaccacggtacttagtacttaagttacgtagggtaggggaaggagggaaggtacgggtaaagtttcgggaaacggttgggggtttacgggtcgggggacccgtaacggggg

SEQ ID NO: 266872 - DNA, 617 bp, Homo sapiens
  misc_feature: GYAE6OF01B4BN3.28.57.F02.1.454.CMB.1.raw
  modified_base (318)..(318): a, c, t, g, unknown or other
  misc_feature (318)..(318): n is a, c, g, or t
  modified_base (455)..(455): a, c, t, g, unknown or other
  misc_feature (455)..(455): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctggtggagtcgtggggggaggtcgttgggtccaggcccgtggggggtccctggagactcctcctgtgcacgcctgtggacttccaccttcagttatttatgtctatgcacgtggggtcccnccgaggcctccgaggggaacggactggaatatgtctcgaaggtattaagtaagtatgacgtaaataacattaatattatagactaaactcgtgtaggaagggcagtactcactatccacgaggactaatacaagacncgtctatactacttaanaagtcggtacagtcctaggacgtagcgtagaacggccgtacggtcttagtacttaacgttcgtgggtagggaaggtagggaacggttacgggtaaaggttacgggtaaagggtttagggggttggttcgggggacggtacggggg

SEQ ID NO: 266873 - DNA, 566 bp, Homo sapiens
  misc_feature: GYAE6OF01AYF5V.28.57.F02.1.454.CMB.1.raw
  modified_base (372)..(372): a, c, t, g, unknown or other
  misc_feature (372)..(372): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggcctccgaggggaagggactggaatatgtctcaggtattagaagtaatgacgaaataacattatattangacaaactctaggtagaaggcagtacttcacatctaccgaggactaataccaagaacacgctagtatcttacaaatgggacacgcctagagacgctaggagacncgggtntagtattaagttacgtggtagggaggtacgggaggtacggaagttagggaacggttaaggggttggtgggggacgtaacggggg

SEQ ID NO: 266874 - DNA, 553 bp, Homo sapiens
  misc_feature: GYAE6OF01DW177.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggcctccgaggggaagggactggaatatgtctcgaggtattagaagtaatgacgaataacatatattatgacaaactctgtagaaggcagtattcaccatctaccgaggacaattccaagacacgctgtactcttacaagtcgggacagcctagagagctagacggacacggctagtattagttacgtgggtagggaggagggaggcggtaaagttcgggaaacgttaggggttggtcggggcgaacggggg

SEQ ID NO: 266875 - DNA, 568 bp, Homo sapiens
  misc_feature: GYAE6OF01ER7CD.28.57.F02.1.454.CMB.1.raw
  modified_base (304)..(304): a, c, t, g, unknown or other
  misc_feature (304)..(304): n is a, c, g, or t
  modified_base (383)..(383): a, c, t, g, unknown or other
  misc_feature (383)..(383): n is a, c, g, or t
  modified_base (448)..(448): a, c, t, g, unknown or other
  misc_feature (448)..(448): n is a, c, g, or t
  modified_base (554)..(554): a, c, t, g, unknown or other
  misc_feature (554)..(554): n is a, c, g, or t
tcagagtacgctatcacgaccggtgctcgatttagctcgatatagttgggtctgggagaggagcccccgccctgggtttcccaggtgttctcatttggtgatcagcactgcacacagaggagtcatgacggagtttgggctgagctgggttttccttgttgctatttttaaaggtgtccagtgtgaggtgcagctgggtggagtcgtggggggaggcttgggtccaggccgtggggggtccctgagactctcctgtgcagcctctggattccaccttcagtatttatgctatgcactgggtccncaggctccgaggggaggactaggaatatgtctcgaggtattagaagtatgacgaaataacatatattatgactaaactntgtagaaggcagtatacaccatcacgaggaacaacttaccgaagaacacgtactagtactcctanaacgtcggacacgcctagacgagtcgtaggacggacgacggtcgtagttactagttacggtggtagggagtagggagaggtaagttggtaacggttggggttcggnggggcgtaacgggg

SEQ ID NO: 266876 - DNA, 752 bp, Homo sapiens
  misc_feature: GYAE6OF01CE1R3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcgttggtccagccgtggggggtccctgagactctcctgtgcagcctctggacttccaccttcagttatttatgctatgctacgtcgggtcccgccgaggcctaccggaaggggaacgggtacgtaggaatagtcgtacgtacgtaggttaattaaggaaagttaagtcggacgtaaaataaacgtaattaattattaagtcgaactaaacttcgtaggtaggaaagggtactagtaactttaccaaccgtataccccgtaccgaaacgggtaaacctaaacgtttacccgaaaaggtaaaccctaccggtcttacgttaacttaccttaacgtaaacggtcggggaccaacggtcccgtaggtaaacgggtcggtacgttacgggaagggtaccctaacgggggttaccttaagggttaatttaaacgttacgggttaggggttaaggggaacgggtagggtacgggtaacgggttaaaggtttacgggtaaacgggtttgggggttacgggtcggggggaacccgtaacgggggg

SEQ ID NO: 266877 - DNA, 661 bp, Homo sapiens
  misc_feature: GYAE6OF01BIWEI.28.57.F02.1.454.CMB.1.raw
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttcagtatttatgctatgcacgtgggtccncgaggcctaccgaggggaaggactggaatatgtctcgagtatagaagtatgacgaaataacatatatatgacaaactctagtagaggcagtattacgacctatcctaccgaggtactaacgttaccgaaagaaccacgtcttagtactacttacgaaatcgggacacgtccgtaggaagtacgtaccgtaggaacggaccgacggtacgttaacgttaacgtttaaacgtttaccggtaggggttaagggggaacgggtaaggggtaaaccgggtaccggggttaaaaggtttaaccggggtaaacggggttttaagggggggtttacggggtacgggggggacccggttaaaccggggggg

SEQ ID NO: 266878 - DNA, 562 bp, Homo sapiens
  misc_feature: GYAE6OF01DCN1P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtcccgccaggctccgagggaagggactggaatatgtctcagtattagaagtatgacgaaataacatatattatgactaaactcgtagtggaaagggcagacttcacactctcgaagggacaagttaccaagaacacgtactagtatcttacaagtgggcacgtcctgagagcgtagacggacacggctgtattagtacgtggtagggaggtaggaaggacggtaagttacgggaaacgttaggggttcggtggggcgtaacggggg

SEQ ID NO: 266879 - DNA, 800 bp, Homo sapiens
  misc_feature: GYAE6OF01ECM6I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcggtgggggaggcgttggtccaggccgtggggggtccctgacgactctcctgtcgcagcctcgtggattccaccttcagttatttatgctatcgcacgtgggtcccgccgaggcctaccggaaggggaacgggactagggaactagtcgtctacgtaggttaagttaaggaaagttaagtacgaacgtaaaataaactaattaataatttaatacggtaacctaaaacgttcgtaggttaacggaaaggggtacctaaggtaacttaccgaacctaacgtacccgtaaccggaacgggtaacctaaacgttaacccgaaaacgtaacctaaccggtacttagtaacctttaccgttaaactaaaggtccggggaactaccggtaccgttaggacggtaaccgtacgttacgggaaccgggaccgtaaccgggtaccgttaaggtttaaacgtttaacggtttaaccggtaggggttaaggggggaaggttaaacgggggaaagggtacccgggggttaaaaggtttaccgggggaaaacgggttttaagggggtttcggggtaacccggggggaccgggttaaacccggggggg

SEQ ID NO: 266880 - DNA, 698 bp, Homo sapiens
  misc_feature: GYAE6OF01EJ379.28.57.F02.1.454.CMB.1.raw
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccnccaggctccgagggaggactggaatntgtctacgaggttattagaagtaatgacgtaaataacatattaattatgactaaactcgtgtaggaagggcctaagtaacttccgaacctagttaccgtaccgaacgggtaaacaaacgtttacccgaaaacggaaccaaccggtacttaacggttaactttaccgtttaaacgtaaaacggttccggggtactaacggtacccgttagggaacgtacggtacgtacggtaacgggaaccgtaccgggtacgttagggtaaactttaggtttaccgtaggggttaagggagggtaaggggtacgggaacggttaaggttacgggtaaacgggttaagggggtttcggtacgggggtcccgtaaacgggggg

SEQ ID NO: 266881 - DNA, 748 bp, Homo sapiens
  misc_feature: GYAE6OF01DNS1D.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggaggcgttggtccagccgtggggggtccctgagactctcctgtgcacgcctctggattccaccttcagttatttatgctatgctacgtcgggtcccgccgacggcctccgaaggggaagggactaggaatagtgtctcgtaggtattaagaagtaatgacgtaaataacattaattatatagactaaactctaggtacgaaacgggtctaagtactttccgaacctacttaccgtaccgaacgggtaacctaaacttaccgaaaacgaacctaacggtactttaacgttaactttaccgttaaacgtaaaacggttccggggaaccgtaaccggtacccggttaggaacgggtaacggacggttaacgggaacgggtaaccggaaccgggttaccttaggttaaacttaacggtttaccgggttggggtaacgggggaaagggtacgggggaaacgggttaacgggttaaaagggtttacggggtaaaccgggtttagggggttacggggtccggggggaaccgggtaacccgggggg

SEQ ID NO: 266882 - DNA, 605 bp, Homo sapiens
  misc_feature: GYAE6OF01CV7A7.28.57.F02.1.454.CMB.1.raw
  modified_base (377)..(377): a, c, t, g, unknown or other
  misc_feature (377)..(377): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctgggtggagtcgtgggggaggcttggtccaggccgtggggggtccctgagactctcctgtgcagcctctggattcaccttcagttatttatgctatgcacgtcgggtccgccaggctccgaggggaaggactggaatagtgtctcgtaggtattaagaagtaatgacgtaaataacatatattangtactaactgtgtaggaaggcagtacttacaccgtatcctaccgaagggaactaacgttaccaaagaaccacgtacttagtacttccttaacaaagtcgggactacgccgtaggagtagcgtaggacggactacggtctagtacttagttacgtgggtaggggaagtaggggacggtaaggtaagttacgggtaacggttagggggttcgggcggggtacgtacgggg

SEQ ID NO: 266883 - DNA, 669 bp, Homo sapiens
  misc_feature: GYAE6OF01EJQD4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtcccctgagactcctcctgtgcagcctctggattcaccttcagtatttatgctatgcacgtgggtcccgccaggcctccgaggggagggactggaatatgtctcaggttattagaagtaatgacgaataacataatattatgacaaactcgtagtaggaaagggctaagtacttaccaaccctatccgtaccgaagggtaactaacgttacccaaagaaccaaccgtcttagtaacttaccgtttaacaaagtcggggacgtacgtacctaggacggtacgtcgtaggacggaacggaccggtacgttaggttaacgtaagtttaaccgtggggttaggggaaggtaacggggaagggtaccgggttaaaaggttacggggtaaaccggtttaggggggtttacgggtggggggggtacccggtaaacgggggggg

SEQ ID NO: 266884 - DNA, 576 bp, Homo sapiens
  misc_feature: GYAE6OF01CT4DK.28.57.F02.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
  modified_base (438)..(438): a, c, t, g, unknown or other
  misc_feature (438)..(438): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttcagttattangctatgcacgtggtcccncaggctccgaggaggactggaatatgtctcgaaggtattagaagtaatgacgaatacatanattatgacaaactntagtagaagggtcagactcacatctacaggaacaacgtaccaagaactacgctagtatacttanaatagggacacgccgtgagacgacgtagacggacacggcgtagtactaagttacgtggttagggaacggngggaacgtacgggtaaagttaccgggtaaacggttaaggggttgggtacgggggtcgtaaacgggggg

SEQ ID NO: 266885 - DNA, 557 bp, Homo sapiens
  misc_feature: GYAE6OF01EILC7.28.57.F02.1.454.CMB.1.raw
  modified_base (448)..(448): a, c, t, g, unknown or other
  misc_feature (448)..(448): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcacctttcagtatttatgctatgcacgtgggtcccgccaggcctaccgaggggaagggtactggaatagtgtctcgaggtattagaagtatgacgaaataacatatattatagacaaactctgtagaggcagtatcacatctacgaggacattaccaagaacacgtctgtatctacaatgggacngacctagagagctaggacggacgacggtctagttactagttacggtggtagggaggaggagtaggtaagttagggaaacgttaggggttacggtggggccgtaacgggg

SEQ ID NO: 266886 - DNA, 575 bp, Homo sapiens
  misc_feature: GYAE6OF01AT6M9.28.57.F02.1.454.CMB.1.raw
  modified_base (353)..(353): a, c, t, g, unknown or other
  misc_feature (353)..(353): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtcgggtccgccaggctccgagggaagggactggaatatgtctcgaggtattaagaagtaangacgaaataacatatattatgactaaactctgtagaagggcagtattcaccatctaccgagggaactaacttaccaaagaaccacgctagtacttcttaacaagtgggacacgcctaggacgtagcgtaggacgacgacggctagtattagttacgtgggtagggaggaggaggtacggtaagttagggaacggttaggggttggtcggggcggtaacgggg

SEQ ID NO: 266887 - DNA, 772 bp, Homo sapiens
  misc_feature: GYAE6OF01EHE0I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctgtggacttccaccttctagttatttatgctatgctacgtcgggtcccgccgaggcctaccggaagggggaagggaccgtaggaattagtcgtcctacgtaagggtttaatttaaggaaagttaagtacggaacgtaaaataaactaattaattaatttaagtacgaactaaaacttcgttaggtaggaacgggactaagtacttaccaacctatcccgtaacccggaagggtaaaccttaaacttacccgaaaacgaacctaccggtaccttaggttaacttaccctttaacggaaacgtcggggacctaacggtccgtaggaacggacggtaccgtagggaacgggtaccgacgggtaccgttaggttaaacgttaacgttttacgggtaggggttaacgggggaagggtaaacggggtaacggggtaacgggtttaaaacggtttaacgggggaaacgggttttaggggggggttttacgggaccgggggggtcccggtaaaccggggggg

SEQ ID NO: 266888 - DNA, 685 bp, Homo sapiens
  misc_feature: GYAE6OF01EV8SY.28.57.F02.1.454.CMB.1.raw
  modified_base (304)..(304): a, c, t, g, unknown or other
  misc_feature (304)..(304): n is a, c, g, or t
  modified_base (332)..(332): a, c, t, g, unknown or other
  misc_feature (332)..(332): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctgggtggagtcgtggggggaggcttggtccaggccgtggggggtccctgagactctcctgtgcagcctctggacttcaccttcagttatttatgctatgcacgtgggtccnccgaggctccgaggggaggactggaatntgtctcgaggtatagaagtatgacgaaataacatataattatagactaaactctaggtagaacgggcaagtacttaccgaacctatcccgtaccgaagggaactaaacttacccgaaagaaccaccgtacttagttaacttacctttaacaaagttggggaacctacggtacccgtaggacggtagtacgtacgggaacgggaccgtaccgggtacttaggttaaattaacgtttaccggttaggggttacgggggaagggtaacggggaacggggtaccgggttaaaggtttacgggggtaaacggtttaggggggtttacgggtccggggggaacccggtaaccggggggg

SEQ ID NO: 266889 - DNA, 669 bp, Homo sapiens
  misc_feature: GYAE6OF01BPET7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcaccttcagtatttatgctatgcacgtgggtccgccaggcctccgagggaagggactggaatatgtctcaggtattagaagtaatgacgaaataacatatattatgacaaactctagtagaagggcagtacttcacctatcctacgaagggaactaacttaccaaagaaccacggtcttagtatacttacaaagttcggggactaacggacccttaggaacgtacggtaccgtaggaacgggaaccgtaccgggtacgttacggttaaactttaacggtttaaccggttggggttagggggaagggtaaagggggaacgggtacggggtaaagggtttaacggggtaaacgggtttaagggggggttttacgggtacgggggggtacccggtaaaccggggggg

SEQ ID NO: 266890 - DNA, 546 bp, Homo sapiens
  misc_feature: GYAE6OF01ABY4R.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggctccgagggaagggactggaatatgtctcgaggtattagaagtaatgcgaataacatatattatgacaactctgtgaggcagattcacatctcaggacaattccaaagacacgctgtactcttacaagtgggacagcctgagagcctaggacggtacacgggtctgtactattacgtggtagggagtgggaggtcggtaagtttcgggaaacgttggggttcggtcgggggccgtaacggggg

SEQ ID NO: 266891 - DNA, 680 bp, Homo sapiens
  misc_feature: GYAE6OF01E1CI8.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtcccgccaggcctccgaggggaagggactggaatatgtctcgaggtatagaagtaatgacgaaataacatataattatgactaaaactctaggtagaagggcaaggtattccaaccatcctaccgaagggaacctaaattccaaacgaaccacgtctagtattaccttaacaaagttcgggacacggtccctaggaagggtacgtacgttagggaacgggaacccacgggtaccttaggtttaaacttaaagttttaaccggttggggttaagggggaagggtaaggggtaacgggtaaccggggttaaaaggttttacgggggaaaaccggtttaagggggggttttcggggtacgggggggtaccccggtaaacggggggg

SEQ ID NO: 266892 - DNA, 593 bp, Homo sapiens
  misc_feature: GYAE6OF01B6IQU.28.57.F02.1.454.CMB.1.raw
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcgagcactggcacacagaagagtcatgacggtgtttgggctgagcttgggttttccttgttgcttagtttttaaaggtgtccagtgtgaggtgcagctggtggagtcgtgggggagcgttggtccagccgtgggggtcctgagactctcctgtgcagcctntggtattcaccttnagttatttangctatgcacgtgggtcccncaggctccgaggggaaggactggaatgtgtctanaggtatagaagtaactggactaaataanattaattactatcgaactaaacttgtagtaggaagggctagtactcactatcctacgaggaaactaactaccaaaggaaccacgtcttagtacttcttaactaaagngggacacggacctagagtcgacgtgacggtacgacggacttagtattacgtaggtgggtacgggagagggacgaggttaagttcgggaaggtttagggtcgggtgggcgtaacggggg

SEQ ID NO: 266893 - DNA, 579 bp, Homo sapiens
  misc_feature: GYAE6OF01D2OXH.28.57.F02.1.454.CMB.1.raw
  modified_base (299)..(299): a, c, t, g, unknown or other
  misc_feature (299)..(299): n is a, c, g, or t
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcactgggtccnccaggctccgagggaagggactggaatatgtctcgaggtattagaagtaatgacgtaataaacatatattatgactaaactctggtagaagggcagtattccacctatcctaccgaagggtacaacttaccgaaagaaccacgtcttagtacttcttacaagtgggacagcctagagagcgtggacggacncgggacttgtaacttagttacgtgggtagggaggagggaggcgggtaaagttcgggaaacgttggggttggcgggggcccgtaaggggg

SEQ ID NO: 266894 - DNA, 591 bp, Homo sapiens
  misc_feature: GYAE6OF01B3YNM.28.57.F02.1.454.CMB.1.raw
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtcagtgtgaggtgcagctggtggagtcgtgggggaggcgttggtccagccgtggggggtccctggagactctcctgtgcagcctcgtggattcaccttcagttatttatgctatgcacgtgggtcccnccaggcctccgagggaacggactaggaatagtgtctacgtaaggttattaagaagtaatgacgaaataacattatattatgacaaactctagtaggaacggcagtacttacactatacacgtaggactaacgtaaccaagaactacgactagtacttactaacaagtcgggacacgtaccgtagacgacgacgtaggaggacgcggtactagtactagttacgtggtagggaggacgggtagacggtaagttacgggaacggttagggtgggtggggaccggtacgggg

SEQ ID NO: 266895 - DNA, 761 bp, Homo sapiens
  misc_feature: GYAE6OF01DTLG5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttcctgttgcttattttaaaggtgtccagtgtgaggtgcagctggtggagtcgtgggggagcgttggtccaggccgtgggggtccctgagactctcctgtgcacgcctctggattccaccttcagttatttatgtctatcgctacgtcggggtcccgccgtacggccttacccggaagggggaacgggtacgtagggtaaattagttcgtaccttacggtaaaggttaagttaaggaaaggttaatacggaacgtaaaattaaactaattaattaattaagtgaacctaaactcgtaggtaggaaacgggtctaagtacttaccaacctagttacccgtaacccggaaagggtaaccctaaacgtttacccgaaaacgtaaccgtaccgttaccttaagttaaccttaccgtttaaacgaaacggttcggggaaccaacggtccgttaaggaacggtacgtaccggttaggaaccggtaaccggtacgggttacttaagttaaacgttacgtttaccgggtgggtaaggggacggtaaaggggacggtacgggttaagttaacggggtaacgggtttagggggttcggtccgggggaccgtaaccggggg

SEQ ID NO: 266896 - DNA, 663 bp, Homo sapiens
  misc_feature: GYAE6OF01BHO4T.28.57.F02.1.454.CMB.1.raw
  modified_base (601)..(601): a, c, t, g, unknown or other
  misc_feature (601)..(601): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtcgtgggggaggcttggtccagccgtggggggtccctgagactctcctgtgcagcctctggattcaccttcagtatttatgctatgcacgtggtccgccgaggcctccgaggggaacgggactaggaatagtgtctacgaggttattaaggaacgtaatggacgtaaataaacgtaattaagttatttaactagtacctaaaacgttcgtaggtacggaagggctaaggtactttaccgaacccgtattccgtacccggaagggtaacctaaacgttaccccgaaaaggtaaccctacggtaccgttagtttaaccttcgtttaaccgaaagttcgggacctacggcccgtaggaacgtacgtcgtaggacggtacacgggtctaggttactagtttacgnggtagggaggacggaggtacggtaagttcgggaagttaggggttggccggggtcgtacgggg

SEQ ID NO: 266897 - DNA, 651 bp, Homo sapiens
  misc_feature: GYAE6OF01CFFZV.28.57.F02.1.454.CMB.1.raw
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggcttggtccaggccgtggggggtccctggacgactctcctgtgcagcctctggattcacctttcagttatttatgctatgcacgtgggtccgccaggcctccgaagggaagggactggaatatgtctctaggtattagaagtaatgacgaaataacatatattangactaaactctgtaggaaggcagattcaacctatctaccgaggaacaacgttaccaaagaaccacgtctagttactaccgtttacaaagttcgggactacggtaccctaggaacggtacgaccgttagggaacggaccgtaaccgggtccttaggttaacgttaagtttaccgttaggggtaggggaaggtacggggtacggtaacggggtaaggtttacggggtaaacggttagggggtttcgggtaggggggacccggtaaacgggggg

SEQ ID NO: 266898 - DNA, 656 bp, Homo sapiens
  misc_feature: GYAE6OF01BOYZX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggtccagccgtggggggtccctgagactctcctgtgcagcctctggattcaccttcagttatttatgctatgctacgtgggtcccgcgaggcctccgaaggggaacgggactaggaatatgtactcgtaggtattaagaagtatgacgaataaacatataattatgaactaaactcgtggtagaagggcagattaccacctatcctacgaaggaacctaacgttaccaaagaaccacgtcttagtacttacttaacgaaagttcgggacctaggtaccctaggaacgtaggtacccgttagggaaccggtaccaccgggtacttaggttaaacttaacgttacggtggggttaagggacggtaaggggaacggtaacgggttaaggtttacggggaaacgtttaggggggttcgggtcggggggaccgtaacgggggg

SEQ ID NO: 266899 - DNA, 665 bp, Homo sapiens
  misc_feature: GYAE6OF01BOGWE.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgctatgcacgtggggtcccnccaggcctccgaggggaacgggactggaatatgtctcgaggtattagaagtaatgacgaataacatattattatgactaaactctaggtaggaaagggtcaagtacttaccacctaatccgtaccgagggtaactacttacccaaagaaccacgtactagttactacttacgaaagtcgggactacgcccgttaggaacgtacggtacgtacgggaacggacgaccgggtacttaggttaacgttaagtttaccggtagggttaggggaacggtaaggggtacgggtaccggggttaaaagtttacgggggtaaacggtttacgggggttaggggttacccgggggacggtaaccgggggg

SEQ ID NO: 266900 - DNA, 561 bp, Homo sapiens
  misc_feature: GYAE6OF01CQWV1.28.57.F02.1.454.CMB.1.raw
  modified_base (305)..(305): a, c, t, g, unknown or other
  misc_feature (305)..(305): n is a, c, g, or t
  modified_base (334)..(334): a, c, t, g, unknown or other
  misc_feature (334)..(334): n is a, c, g, or t
  modified_base (376)..(376): a, c, t, g, unknown or other
  misc_feature (376)..(376): n is a, c, g, or t
  modified_base (442)..(442): a, c, t, g, unknown or other
  misc_feature (442)..(442): n is a, c, g, or t
  modified_base (465)..(465): a, c, t, g, unknown or other
  misc_feature (465)..(465): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctggagactctcctgtgcagcctctggattccaccttcagttatttatgctatgcacgtgggtcccnccgaggctccgaggggaaggactggaatntgtctcgaggtatagaagtaatgacgaaataacatatattangacaaactctgtagaggcagattcactatcgtacgaaggacaagtccaagacacgctgtatcttanaagtgggactagcctagagtagngtagacggacagggtctagtattattacgtgggtagggagtagggagacggtaagttcggtaaacgttgggggttacggngggggacccgtagggg

SEQ ID NO: 266901 - DNA, 808 bp, Homo sapiens
  misc_feature: GYAE6OF01CH4FD.28.57.F02.1.454.CMB.1.raw
  modified_base (803)..(803): a, c, t, g, unknown or other
  misc_feature (803)..(803): n is a, c, g, or t
  modified_base (807)..(807): a, c, t, g, unknown or other
  misc_feature (807)..(807): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccaggggaagggactggaatatgtctcaggtattagaagtaatgacgaataacatatattatgacaaactctgtagaagggcagattcaccatctccgaggacaattcaaagacacgctgtatcttacaaagtggacagcctaggacgagctaggacggacgtacggctagttaattattacgtggtagggagtagggacgacgggtaattagggaaacgttaggggttagggtcggggaccgaaggggtccggtaccccgttggggtaccctacccgttccgtcccgttacgtaccggcccctaacccgaaacccggaaaccggggtccccctaacggtttcccccgggtttcccccgtttacccccccggtgggtcccccggtccccccgtcgggtacccccgttaccgggaacccgggtacccggacccgtaacccccggtacccgggaacgggacccgacccgaaaccggcccgggtaccccgggtccccggttcgggggccccgtttcgggtaccccgggtttacggggttaacccggaaaccgggtaccctttaaccccgttacccgaaacggttaccggttaacccgttacgttcccggtacgggtacgggaccccggggcggttaaccgggaccgtaccggggaccgtacccgtaaggtagacngtgng

SEQ ID NO: 266902 - DNA, 646 bp, Homo sapiens
  misc_feature: GYAE6OF01B57TM.28.57.F02.1.454.CMB.1.raw
  modified_base (627)..(627): a, c, t, g, unknown or other
  misc_feature (627)..(627): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggtttccttgttgctattttaaaggtgtccagtgtgaggtgcagctggtggagtctgggggaggcttggtccagcctggggggtccctgagactctcctgtgcagcctctggattcaccttcagttatttatcgtctatgctacgtcggtcccgccgaggtcctccggaaggggaacgggtacgtaggtaatagtgtctacgtaggttattaaggaagttaatcggacgaaataactaattaataattagtagaacctaaacttcgtagtaaggaagggtacaagtacttaccaacctagtcctaccggacggaactaacttaccgaaacgaccgacgtcgtagttacttaccttacaagtcggacacgcctaggagtacgaccgtggaacggtaccacggtcttagtattacgttacgtgggttagggaggaagggacggtacgggtaagtttacggggaaggtttagggggttcggngggggaccggtaacggggg

SEQ ID NO: 266903 - DNA, 675 bp, Homo sapiens
  misc_feature: GYAE6OF01CBOKB.28.57.F02.1.454.CMB.1.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtccagtgtgaggtgcagctggtggagtcgtggggggaggcttggtccaggccgtggggggtccctgagctctccngtgcagcctctggacttcacccttnagttatttatgtctatgctacgtcggggtacccgccgacggccctccgaagggggaacggactaggaatagtgtctacgaggttaattaaggaaagttaactggaacgaaataaacattaatattaatagaactaaaactcgtaggtacggaaagggactaaggtacttacaacctactacctacccggaagggtaaactaacttaaccgaaagaaccacgtacttacgtaactcgttaacgaagttcgggacacgaccgtaggaacgagtcgtaggaacggaccgtacggcgttaagtacttaagttacgtgggtagggtaagacggggtaacggtagggtaaacggttagggtaaacgggttagggggttcggtcgggggtccgaaaccgggggg

SEQ ID NO: 266904 - DNA, 805 bp, Homo sapiens
  misc_feature: GYAE6OF01DI8UT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttatttttaaaggtgtccagtgtgaggtgcagctggtggagtcgtgggggaggcttggtccagccgtgggggtccctgagactctcctgtgcagcctctggacttccacctttcaagttatttatgcttatgcacgtggggtcccgccgacggcctccggaaggggaacgggacctagggaaacttagtcgttacgtacgtaaaggttatttaaggaaagttaaagtcggaacgtaaaattaaactaattaattaaatttagtacgtaactaaaacttcgtaggtaggaaacggggctaaggtactttaccaaccgtacttaccgtacccgtaaagggtaacctaaacgtttacccgaaaacgtaaacccgtaccgttaccgttaagttaaccttacgtttacgaaaacggttcgggaactaaccgtacccgttaggacggtaacgtacggttaacggaacggggtaccaaccggggtctttaacggttaaacgtttaacggtttaaccggtttagggggtaaccgggggtaaaggtaacgggggtaaacggtaacggggtttaaacggttaacggggttaaaaccgggtttaaggggggttttacgggggtaccggggggtacccgggtaaaccggggggg

SEQ ID NO: 266905 - DNA, 742 bp, Homo sapiens
  misc_feature: GYAE6OF01DB4CJ.28.57.F02.1.454.CMB.1.raw
  modified_base (399)..(399): a, c, t, g, unknown or other
  misc_feature (399)..(399): n is a, c, g, or t
  modified_base (632)..(632): a, c, t, g, unknown or other
  misc_feature (632)..(632): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagcgtggtggagtcggtggggggaggtcgttggtccgaggccggtgggggggtcccctggacgtaccttctcctgtcgccgacgtcctcgtggtactttccacctttcagttatttatcgcttatcgcacgttcgggtcccgccaggcctaccggaagggaaggactaggaattatcgtctacgtaggttaattaaggaaagttaanaggtaacgtaaaattaactaattaataatttagtacgtaactaaaacttccggttaggtaagggaaacgggtactaagtacttaccaaccgtaacttcccgtaaccgaagggtaaacctaaacgttacccaaagtaaccacgttacttaacgtaacttaccgttaacaaacggtgggaacctacgtaccgtaggaacggtaacgacggtacgggaacggacggtaacccggtnttacggttaaattaacgttaccggtagggtaaggggaggaacggggaggtaacgggtaaggttaacgggtaaggttagggggttcggggacggggtaccggtaacggggg

SEQ ID NO: 266906 - DNA, 694 bp, Homo sapiens
  misc_feature: GYAE6OF01B5D9B.28.57.F02.1.454.CMB.1.raw
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtggggggtccctgagactctcctgtgcagcctctggattcaccttcagttatttatgctatgcacgtgggtccnccgaggcctaccgaaggggaacggactaggaatatgtctcgtagtattaagaagtagtacgaacgtaaataacaattaagttaatttagtacgaacctaaaacttcgttaggtaagggaaacgggtactaagttaacttacccaaccctaacttacccgtacccggaaacgggtaaacctaaacgttaacccgaaacgaaacccgaccgtcttaagtacttacctttaacgaagttcgggactacgaccgtaggacgtagacgtaggaacggacgtaccggtcttaagttacttaagtttacgtggggtagggaagggtagggacgggtaacggttaaggttacgggtaaacgggttaggggttcgggtacggggggtacgtaaccgggggg

SEQ ID NO: 266907 - DNA, 596 bp, Homo sapiens
  misc_feature: GYAE6OF01BZEH1.28.57.F02.1.454.CMB.1.raw
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (501)..(501): a, c, t, g, unknown or other
  misc_feature (501)..(501): n is a, c, g, or t
  modified_base (539)..(539): a, c, t, g, unknown or other
  misc_feature (539)..(539): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttattttaaaggtgtccagtgtgaggtgcagctggtggagtcgtgggggagcgttggtccaggccgtgggggtccctgagactctcctgtgcagtcctctggattcaccttcagttatttatgctatgcacgtgggtcccgccaggcctaccggaaggggacggtactaggaatagtgtctagaggttaattaaggaagttaatgacgtaaataaactattaataattatacgaactaaactgtagtagaaggtcagtactacactatcgtacgaggaactaactacgaaanaccncgtatgtacttctacaagtcgggacaacgcctaggacgtanccgtaagacggacgacggtctaggtacttagttacggnggtagggagagggtagaggttaagtggtaacggtagggttggcggggccgtaacggg

SEQ ID NO: 266908 - DNA, 556 bp, Homo sapiens
  misc_feature: GYAE6OF01CKUJO.28.57.F02.1.454.CMB.1.raw
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
  modified_base (460)..(460): a, c, t, g, unknown or other
  misc_feature (460)..(460): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctattttaaaggtgtccagtgtgaggtgcagctggtggagtctgggggagcttggtccagcctggggggtccctgagactctcctgtgcagcctctggattcaacctttcagttatttangctatgcacgtgggtcccncaggctccgaggggaaggactggaatatgtctacgaggtaattagaagtaatgacgtaaataacattaatattangacaaactctagtagaggcagattcacatctacgaggactaactccaaagtacagtctgtatcttacaagtcggacaagcctagagngtctggacggacgacggtctagtatagttacgtagggtgggagagggagtacggtaagttaggaaacgttggggttaggtcggggcgtaacggggg

SEQ ID NO: 266909 - DNA, 548 bp, Homo sapiens
  misc_feature: GYAE6OF01EQ24N.28.57.F02.1.454.CMB.1.raw
  modified_base (506)..(506): a, c, t, g, unknown or other
  misc_feature (506)..(506): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgaggggaggctggatatgtctcgaggtatagaagtatgacgaataacatatattatgacaaactctagtagaagggcagtacttcaccatcctaccgagggaactaacttacccaaacgaacaccgtctagtactcttacaaagtgggacagcctagagagctagaggacgacggctagtatattacgtggtagggagngggagcggtaagttggaacgttggggttggtggggcgagggg

SEQ ID NO: 266910 - DNA, 561 bp, Homo sapiens
  misc_feature: GYAE6OF01A1Q4N.28.57.F02.1.454.CMB.1.raw
  modified_base (473)..(473): a, c, t, g, unknown or other
  misc_feature (473)..(473): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtcccgccaggctccgagggaaggactggaatatgtctcgaggtattagaagtaatgacgaataacatatattatgacaaactctgtagaagggcagatcacatctcgaggacaattaccaagaaccacgtctagtatctacaagtgggcagcctagagacgctaggacggacacggnttagtattaagttacgtggtaggggaagagggaggtacgggtaaagttagggaacggttaggggttcggtgggggccggtaacggggg

SEQ ID NO: 266911 - DNA, 608 bp, Homo sapiens
  misc_feature: GYAE6OF01CYEBH.28.57.F02.1.454.CMB.1.raw
  modified_base (180)..(180): a, c, t, g, unknown or other
  misc_feature (180)..(180): n is a, c, g, or t
  modified_base (316)..(316): a, c, t, g, unknown or other
  misc_feature (316)..(316): n is a, c, g, or t
  modified_base (394)..(394): a, c, t, g, unknown or other
  misc_feature (394)..(394): n is a, c, g, or t
tcagagtacgctatcacgaccggtgctcgatttagctcgatatagttgggttcgtgggagaggacgcccccgccctgggtttcccaggtgttctcatttggtgatcagcactgcacacagaagagtcatgacggagtttgggctgagcttgggttttccttgttgcttatttttaaaggngtccagtgtgaggtgcagctggtggagtcgtgggggaggcttgggtccagccgtggggggtccctggacgactctcctgtcgcagcctcgtggtattcacctttcagtttacttagtgctatgcacgtgggtcccnccgaggcctcccgagggaacggcgtggaactagtgtctacgaggtatagaagtaatgacgtaataacattataattanagtactaactgtagtagaagggcaggtacttacacctatacctaccgaggtacaagtaccaagacacgtactgtactcttacaagtcgggcaacgcctaggagtagcgtaggacggtacgacggtcgtagtaacttagttaacgtggtaggggaggaaggaggtacggtaagttacgggtaacgttaggggttacgggtaggggcgtaacgggg

SEQ ID NO: 266912 - DNA, 556 bp, Homo sapiens
  misc_feature: GYAE6OF01A16WK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactgggaatatgtctcaggtattagaagtaatgacgaaataacatatattatgacaaactctgtagaagggcagattcaccatcctcgaggacaacttccaagaacacgctgtatcttacaagtcgggacacgtcctaggagtagctggaggacacggctaggtatagttacgtggtagggaggtagggagacgggtaagttgggaacgttaggggttcggtgggggccgtaacggggg

SEQ ID NO: 266913 - DNA, 794 bp, Homo sapiens
  misc_feature: GYAE6OF01DSOB3.28.57.F02.1.454.CMB.1.raw
  modified_base (314)..(314): a, c, t, g, unknown or other
  misc_feature (314)..(314): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggaggtcttgggtccaggccgtggggggtccctggagacctctcctgtcgcagcctcgtggtacttcacctttcagttatttatgctatcgctacgtgggtcccnccgaggcctaccgaggggaacggtaccgtaggaactagtacgttcctacgtaaggtattaacggaagttaagtgaacgtaaataaactacgttaattaattacgtgaacctaacttccgtggtacggtaaagggactaacgtactttacccgaccgtaagttcctacccggtaacgggtaaccttaaacggtttacccgaaaggtaacccgtacggttacccgtttaggttaaccgtttacctttaaccggtaaaacggtttccggggaacgtaaccggttacccgttaaggacgggttacgtacggttaccgggaacgggtaccgtaaccgggttacgttaaggttaaccgttaggttaccggttacggggttaagggggacggttaaacgggggtaacggtaacgggttaaacggtttacggggaaacggtttacgggggggtttacgggtaccggggggtccgttaaaaccgggggg

SEQ ID NO: 266914 - DNA, 606 bp, Homo sapiens
  misc_feature: GYAE6OF01CW6H2.28.57.F02.1.454.CMB.1.raw
  modified_base (377)..(377): a, c, t, g, unknown or other
  misc_feature (377)..(377): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattccaccttcagttatttatgctatgcacgtgggtccgccgaggctccgaggggaacggactaggaatatgtctacgaggtattaagaagtatgacgaataacatatattangacaaactctgtagaagggcagtacttcacctatcctaccgagggactaacttaccaaagaccacgtcttacgtacttccttaacgaaagtcgggactacgccgtaggacgacgtcgtaggacggaccgacggtctagttattagtacgtgggtagggaggtagggacggtaacgggttaaggttagggaaccggttagggggttacggtcgggggacggtaacggggg

SEQ ID NO: 266915 - DNA, 669 bp, Homo sapiens
  misc_feature: GYAE6OF01B0D3G.28.57.F02.1.454.CMB.1.raw
  modified_base (367)..(367): a, c, t, g, unknown or other
  misc_feature (367)..(367): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcttggtccagccggtgggggtccctgagactctccgtgtgcagcctcgtggacttccaccttcagttattttatgtctatcgcacgtcgggtcccgccgaggcctccgaaggggaaggactaggaatagtgtctgaaggtattaagaatangacgaataacatatatatacgactaaatcgtagtaggaagggacaagtactccgaacctatacccgtaccgaaggtaacctaaacttacccgaaagaaccacggtcttagtaacttccttaacaaaggttgggacctagtaccgtaggacgtacgtacgtagggaacgacgaccggttattagttaaacttaagtttaccggtggggtaaggggaaggtaaggggacgggtaacggttaaacgggttacggggtaaacggtttagggggtttacgggtccggggggacccggtaaacggggg

SEQ ID NO: 266916 - DNA, 730 bp, Homo sapiens
  misc_feature: GYAE6OF01C74Y6.28.57.F02.1.454.CMB.1.raw
  modified_base (302)..(302): a, c, t, g, unknown or other
  misc_feature (302)..(302): n is a, c, g, or t
  modified_base (391)..(391): a, c, t, g, unknown or other
  misc_feature (391)..(391): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagttatttatgctatgcacgtgggtccnccgaggctccgaggggaacggacgtaggaatagtcgtctacgaggttaattaaggaaagtaactgaacgaaataaacaatattaattangactaaactctaggtaggaagggctagactttccaacctattccgtaccggaagggtaacctaaacgttaacccaaaggtaacccaacgtacgtttacgtaactttaccctttaacgaaaaggttcggggacctaaccgggtaccccgttagggaacggtagtaccggttaagggaaccgggaccgtaaccgggtactttaaggtaaacgtttacgtttacgggtaggggttacgggggaagggaacgggggtaacgggtaacgggttaaagggtttacggggtaaaaccgggtttggggggtttcgggggaacggggggtcccggtaaaccggggggg

SEQ ID NO: 266917 - DNA, 551 bp, Homo sapiens
  misc_feature: GYAE6OF01D8WM5.28.57.F02.1.454.CMB.1.raw
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
tcagagtacgctatcacgaccggtgctcgatttagctcgatatagttgggtctgggagaggagcccccgccctgggtttcccaggtgttctcatttgggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggcctccgagggaagggactggaatatgtctcgaggtattagaagtaatgacgaataacatatattatgacaaactctagtagaaggcagntcacatcncaggacaatccaagaacacgctgtactctacaatcgggcaagcctagagagactggacggacgacggctagttatacgttacgtggtaggggaagagggagtacggtaagttagggaacgttaggggttcgggtggggccgtaaggggg

SEQ ID NO: 266918 - DNA, 622 bp, Homo sapiens
  misc_feature: GYAE6OF01ALJVD.28.57.F02.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (537)..(537): a, c, t, g, unknown or other
  misc_feature (537)..(537): n is a, c, g, or t
tcagagtacgctatcacgaccggtgctcgatttagctcgatatagttgggtcgtgggagaggagcccccgcccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctctggattcaccttctagtatttatgtctattgctactggggtcccncgaggcctccgaaggggaggactggaatatgtctcgaggttattaagaataacgngacgaaataacatatattatgacaaactctagtacgaaggcagtattcgacctaatccgtacgaggtaactaataccgaaanaacncgtatctaagtccttaacgaaagttcgggctaacgacctaggaatacggctagggaacgacgaacgtcgttagtaacgttattaacggngggttaaagggaggttaagggaacggtacgggtaaatttacgggggaaacgtttaaggggtgggtcggggggcccgtaaaggggg

SEQ ID NO: 266919 - DNA, 597 bp, Homo sapiens
  misc_feature: GYAE6OF01C7WEM.28.57.F02.1.454.CMB.1.raw
  modified_base (303)..(303): a, c, t, g, unknown or other
  misc_feature (303)..(303): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctcgtggacttcaccttcagttatttatgctagtgcactgggtcccnccaggcctaccgaggggaaggctaggaaatatgtcctnaggtaatagaagtaatgagaaataanatataattangacaaatctagtagaaagggcaagtattacacctatactaccgaagggaactaaacgttaccaaaagaaccaaccgtctacgttactacttaacaaagttggaccgagacctaggagtagcgtagaacggacgtacgcgtagtacttaattacgtggtagggagagggaggacggtaagttacgggaaacgttaggggttcggtaggggaccgtacgggg

SEQ ID NO: 266920 - DNA, 540 bp, Homo sapiens
  misc_feature: GYAE6OF01CENQH.28.57.F02.1.454.CMB.1.raw
  modified_base (299)..(299): a, c, t, g, unknown or other
  misc_feature (299)..(299): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctcgtggattcacctttcagtatttatgctatgcactgggtccnccaggctccgagggaagggactggaatatgtctcgaggtattagaagtatgagaataacatatattatgacaaactctagtagaagggcagatcaccatctacagggactaattaccaagactacgctagtatcttacaagtgggacagacctgagagctagacggacacggntagtatagttacgtggtagggaggaggagaggaagttggaacgttaggggtcggtggggcgtacgggg

SEQ ID NO: 266921 - DNA, 572 bp, Homo sapiens
  misc_feature: GYAE6OF01A7N62.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcttggtccagccgtggggggtccctgagactctcctgtgcagcctctggattcaccttcagtatttatgctatgcacgtgggtcccgccgaggctccgaggggaacgggactggaatatgtctcaggtattagaagtatagacgaaataacatatattatgacaaactctagtagaggcagacttcacctatctacgaggacaattaccaagacacgctagtactcttacaagtggacacgcctagagagctaggacgacgacggtctagtatagttacgtggtagggaggtaagggacggtacgggtaagttacgggtaaacggttaggggtttacgggtggggggtccgtaacggggg

SEQ ID NO: 266922 - DNA, 574 bp, Homo sapiens
  misc_feature: GYAE6OF01CKZXM.28.57.F02.1.454.CMB.1.raw
  modified_base (282)..(282): a, c, t, g, unknown or other
  misc_feature (282)..(282): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (389)..(389): a, c, t, g, unknown or other
  misc_feature (389)..(389): n is a, c, g, or t
  modified_base (425)..(425): a, c, t, g, unknown or other
  misc_feature (425)..(425): n is a, c, g, or t
  modified_base (556)..(556): a, c, t, g, unknown or other
  misc_feature (556)..(556): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagcgtggtttctgtgctatttaagtgtcagtgtgagtgcagcgtggtggagtcggtggggggacggtcgttgggtccaggccggttcgggggggtccctgagcttctccgtgtcgcacgccttcgtaggacttccaccttnagttattatgctatgcacgtcgggtcccgcgaggcctcgaaggggaacggacgtggaatgtgtctagaggttattaagagtaancgaagtaataanatatagttatnaactaaactctaggaggtaaggctagtactacactntacgacgaggtaactactacgaacgactactgtatactctacaagtgctagctagagcgtgagagacgacgtctaagtagttacttcggaggtagggagtacgggagtacggtagttagggaggttagggnggggttgggcgtacgggg

SEQ ID NO: 266923 - DNA, 840 bp, Homo sapiens
  misc_feature: GYAE6OF01EJ03N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtggtggagtcgtgggggagcgttggtccaggccgtgggggtccctgagctctcctgtgcagcctctggattcacctttcagttatttatgctatgctacgtcgggtcccgccgaggtcctaccggaaggggaacgggtactaggaattacgtcgttcgttacgtaaggttaacttaaggaaagttaacgttacggaaccgttaaaaagttaaaaccgtaaattttaaatttaacgtttaacgttacggaaacccttaaaaaccgttccgtttagggttaaacgggaaaacggggttaacctaaacgggtttaactttacccctaaaccccgttaaacgtttccccgtaaacccggtaaacggggtaaacctaaaacgttttaaccccgaaaacgtaaacccgtaaccggttaacctttagtttaaaccgtttaaccgtttaaccgtaaaacggtttccggggacctaacggtacccgttacggaaggtacgtaaccggttaggaccgggaaccgtacggtaccttaggttaacgttaacgtttacggtagggtagggtaaacgggtagggaaacgggttagggtaaaggtttacgggttaacgggttaggggtttacggacggggggtacccggtaacgggg

SEQ ID NO: 266924 - DNA, 558 bp, Homo sapiens
  misc_feature: GYAE6OF01DEDLV.28.57.F02.1.454.CMB.1.raw
  modified_base (374)..(374): a, c, t, g, unknown or other
  misc_feature (374)..(374): n is a, c, g, or t
tcagagtacgctatcacgaccggtgctcgatttagctcgatatagttgggtctgggagaggagcccccgccctgggtttaccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctctggattcaccttcagtatttatgctatgcacgtgggtcccgccgaggctccgaggggaagggactggaatatgtctcaggtattagaagtaatgacgaataacattatattangacaactctggtagagggcagattcacatctcgaggacaataccaagaacacgtctagtacttcttacaagtgggacagcctagacgagtcgtagacggacacggcttagtacttatacgtggtagggaggaggaggacggtaagttacgggaacgttaggggttggtgggggccgtacggggg

SEQ ID NO: 266925 - DNA, 545 bp, Homo sapiens
  misc_feature: GYAE6OF01AWQQH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgagggagggactggaatatgtctcaggtattagaagtatgcgaataacatatattatgacaaactctgtgaagggcagatcacctatctccagggactaattccaagacacgctgtatcttacaatcgggacagcctagagagcgtgacgacacggctgtatagttacgtggttagggacgtagggacgtacgggtaattagggaacgttagggggttcgtggggccgtaacggggg

SEQ ID NO: 266926 - DNA, 542 bp, Homo sapiens
  misc_feature: GYAE6OF01BLK5K.28.57.F02.1.454.CMB.1.raw
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtccgccaggctccgagggaagggactggaatatgtctcgaggttattagaagtatgacgaataacatatattatgacaaactctgtgaagggcagattcaccatcctacgagggacaattccaagaaccacgctgtatcttacaagtgggacagctgagagctggagacncggctgtatagttacgtggtagggaggnggagacggtaagttgggaacgttaggggttggtgggggccgtaaggggg

SEQ ID NO: 266927 - DNA, 822 bp, Homo sapiens
  misc_feature: GYAE6OF01BQV1D.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggttttccttggttgtcttaagtttttaaaggtgtccagtgtgaggtgcagcgtgggtggagtcgtgggggagtcgttggtccgaggccggttcggggggtccctggacgtacttctcccgtgtcgcacgtcctcgtggtacttcctaccttcaagttatttatgctatgcctacgtcggtcccgaccgaggcctaccggaagggaacggtaccgtaggtaatagttcgtaccgttacgtaaggttaagttaaggtaagttaagtacggaacgtaaactaaactaacgttaatttaacgttaagtacgtaaccgtaacgttacgtaggtacgggtaaacggtctaacggttacttacccaaacgttacctaccggtaaccggaacgggtaaaaccttaaaccgtaaacccaaaggaacccgtaacggttccgtaagtttaaccgtacccgttaaacgaaggtcccggggtaactacggtacccgtaacgggagttaccggtacgtaacggggaaccggtaccgtaccggtaagtttacgttaaacggtttaaccgggttacggtagggttaagggggaacggtaacgggaagggtaaccgtttaaagggttaaccggggttaaacggggttagggggttccgggtaacccgggggccgggtaaaccgggg

SEQ ID NO: 266928 - DNA, 527 bp, Homo sapiens
  misc_feature: GYAE6OF01DME8M.28.57.F02.1.454.CMB.1.raw
  modified_base (259)..(259): a, c, t, g, unknown or other
  misc_feature (259)..(259): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
  modified_base (428)..(428): a, c, t, g, unknown or other
  misc_feature (428)..(428): n is a, c, g, or t
  modified_base (474)..(474): a, c, t, g, unknown or other
  misc_feature (474)..(474): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctcnggattcaccttcagtatttatgctatgcactgggtccgccaggctccgaggggagggactggaatatgtctcaggtattagaagtaatgacgaataacatataattatgacaaactctgtgaagggcagattcacatctcaggacaattccaanacanctgtatcttanaaatgggacagcctagagagctagaggacacggctgtatattacgnggtgggagagggagcggaattgggaaacttggggttggtggggccgtaagggg

SEQ ID NO: 266929 - DNA, 609 bp, Homo sapiens
  misc_feature: GYAE6OF01CCSNP.28.57.F02.1.454.CMB.1.raw
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtccnccaggcctccgaggggaagggactggaatatgtctcgaggtattagaagtaatgacgaaataacatatattatgactaaactctgtaggaagggcaagtacttacacctattcctaccgaagggtaactaacttacccaaagtaaccacgtctagtacttcttacaagtcgggacacggcctaggagacgcgtaggaggaccgacggtcttaggtaacttacgtttacgtgggtaggggaaggtagggaggtaccgggtaaagtttcgggaaacggtttagggggttcgggtggggacccggtaaggggg

SEQ ID NO: 266930 - DNA, 571 bp, Homo sapiens
  misc_feature: GYAE6OF01DF36Y.28.57.F02.1.454.CMB.1.raw
  modified_base (377)..(377): a, c, t, g, unknown or other
  misc_feature (377)..(377): n is a, c, g, or t
  modified_base (443)..(443): a, c, t, g, unknown or other
  misc_feature (443)..(443): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtcgggtccgccgaggcctccgaggggaacgggactggaatagtgtctcgaggttaattagaagtaatgacgaataacatatattangacaactctgtagaagggcagattcactatctaccaggacaattaccaagacacgctgtatcttanaagtgggcagtcctagagagcgtaggacggacgacggtacttgtaacttagttacgtgggtagggaggagggacgacgggtaagttacgggtaacgttaggggttcgggcgggggtccgtaacggggg

SEQ ID NO: 266931 - DNA, 750 bp, Homo sapiens
  misc_feature: GYAE6OF01D6RVW.28.57.F02.1.454.CMB.1.raw
  modified_base (207)..(207): a, c, t, g, unknown or other
  misc_feature (207)..(207): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtcagtgtgaggtgcagctggtggagtcgngggggagcttggtccaggccgtgggggtccctgacgactctcctgtgcagcctcgtggacttcgaccttcagttatttatgctagtgccgtacggtcgggtcccgccgaggtcctaccggaaggggaacgggtacctagggtaattagttgttccgtacgtaggttaagttaaggaaacgttaagtacgaacgtaaataaactattaattaattaacgtacgaacctaaacgttcgtaggttaggaaacgggactaagttaacttacccaaccgtacttaccgtaaccgtaagggtaacctaaacgttacccgaaaggtaacccgtacgtacgttaacgtttaacttaccgttaaacgaaagttcggggaacctaggtacccgtaaggacggtaggtaccggtacgggaacggtaccggtacgtacgttaagtatttaacggttaacgggtcggggtagggagggtaaaggaccgggtaaagggttaacgttacggggttaaacggtttagggggtttacgggcgggggaaccgtacgggggg

SEQ ID NO: 266932 - DNA, 589 bp, Homo sapiens
  misc_feature: GYAE6OF01B3X9Y.28.57.F02.1.454.CMB.1.raw
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggggttttccttgttgctatttttaaaggtgtccagtgtgaggtgcagctggtggagtctgggggaggcttggtccaggcctggggggtccctgagactctcctgtgcagcctctggattcaccttcagtattatgctatgcactgggtccgccaggctccgagggaagggactggaatatgtctcaggtattagaatangcgaataacatatattangacaaactntgtagaagggcagattcacctatctaccgaaggacaattaccgaaagaacacgtctagtactcttacaagttgggctagcctagagacgtctaggaacgacgacggtctagttaagttagttaccggtgggttagggaaggtaaggggtacgtaacgggtaagtttacggggaaacgtttaggggggttcggtacggggggccccgtaaagggggg

SEQ ID NO: 266933 - DNA, 590 bp, Homo sapiens
  misc_feature: GYAE6OF01EFU1I.28.57.F02.1.454.CMB.1.raw
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgacctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagtatttatgctatgcatcgggtccgccgaggcctaccggaggggaagggactggaatatgtctcgaggttataagaagtatgacgaataacatatattatnactaaactntgtagaaggcagtacttcacatcgtacgaggaactaacttacaaacgaacacgcttagtacttacttacaaagtgggacacgtcgtagagacgtctaggaaggtacacggtctagttacttagtttacgtcgggtagggaggaggggtaagcgggtaaagttcggggaaacgttgggggttacgggtgggggcccggtaaggggg

SEQ ID NO: 266934 - DNA, 520 bp, Homo sapiens
  misc_feature: GYAE6OF01E4IRJ.28.57.F02.1.454.CMB.1.raw
  modified_base (437)..(437): a, c, t, g, unknown or other
  misc_feature (437)..(437): n is a, c, g, or t
  modified_base (505)..(505): a, c, t, g, unknown or other
  misc_feature (505)..(505): n is a, c, g, or t
  modified_base (513)..(513): a, c, t, g, unknown or other
  misc_feature (513)..(513): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagtatttatgctatgcactggtccgccaggctccagggaggactggaatatgtctcaggtattagaagtaatgcgaataacatatattatgcaaactctgtgaagggcagattcaccatctccagggacaattccaaagaacacgctgtactctacaaatggganccgtagagagctaggagacacggctgtatatactggtggagaggagcggaattgggaactagggttgnggggccgngggtacg

SEQ ID NO: 266935 - DNA, 671 bp, Homo sapiens
  misc_feature: GYAE6OF01D8VSO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggattcaccttcagttatttatgctatgcacgtgggtcccgccaggcctccgaggggaggactggaatatgtctcaggtattagaagtatgacgaaataacatatattatgactaaactctagtagaaggcaagtattacacctatctaccgagggaactaacttaccaaagaaccacgacttagtactcttaacgaaagttcgggactacggtacccgtaggaacgtacgtaccgtagggaacgggtaaccgtaccgggtacttaggttaaacttaacgttttaacggttggggttaagggggaagggtaaaggggtaacgggtaacggggtaaaagttttacgggggaaaaccggttttagggggggtttacggggttacggggggacccgggtaaaccggggggg

SEQ ID NO: 266936 - DNA, 615 bp, Homo sapiens
  misc_feature: GYAE6OF01EBKBT.28.57.F02.1.454.CMB.1.raw
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggaggcttggtccagccgtggggggtccctgacgactctcctgtgcagcctctggattcaccttctagttatttatgctatgcacgtggggtcccaccgaggtctccgaaggggacgggactgggaattatgtctacgaggttattaggaagttaagtgacgtaaataacatataattatgactaaactctgtaggaaggacagtataccacatctaccgaggtactaataccaaacggaacctacggcttagtactaccttacaaggtcggacacgtactagagacgcgtggacgacgacggtcttagtacgttagtttacgngggtaggggaagaggggtaacgtcggtaaagtttcggggtaaacggtttagggggtcgggttacggggccgggtaaacggggg

SEQ ID NO: 266937 - DNA, 543 bp, Homo sapiens
  misc_feature: GYAE6OF01AZMFG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccaggccgtggggggtccctgagactctcctgtgcagcctctggattcaccttcagtatttatgctatgcactgggtccgccaggctccgagggaagggactggaatatgtctcaggtattagaagtaatgacgaataacatatatatgcaaactctagtgaagggcagattcacatctaccagggacaacttaccaagaacacgctgtattactactaaagtcgggacagcctgagagcgtgaggacacggctagtatattgtcggtagggagaggaggaggtaagttaggaacggttagggtgggtcggggcgtaacgggg

SEQ ID NO: 266938 - DNA, 655 bp, Homo sapiens
  misc_feature: GYAE6OF01ENUI8.28.57.F02.1.454.CMB.1.raw
  modified_base (305)..(305): a, c, t, g, unknown or other
  misc_feature (305)..(305): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccaggccgtggggggtccctgagactctcctgtgcagcctctggacttcaccttcagttatttatgctatgcacgtgggtccnccgaggcctccgaggggaaggactaggaatatgtctcgaggtattaagaagtaatgacgtaaataacataatattatgaactaaactcgtgtaggaaaggcagtacttaccaacctatccgtaccgaagggtaacctaaacgttacccaaaagaaccctacggtcttagttaacttccgtttaacaaaggttcgggacctaacggtcccgtaggaacggacgtcgtaggaacggtacgacggtcttagttaaattagtttacggtgggtaggggaaggagggtaaggacggttaaaggtttacgggaaaacggtttgggggttcggggttacggggaccggtaacggggg

SEQ ID NO: 266939 - DNA, 602 bp, Homo sapiens
  misc_feature: GYAE6OF01EXK6A.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattccaccttcagttatttatgctatgcacgtgggtcccgccgaggcctaccggaggggaagggactaggaatatgtctcaggtaattagaagtatgacgaaataacatatattatgactaaactcgtagtgaagggcagtattaccacctatcctacgaaggaactaacttaccgaaagaaccacgcttagtactaccttacaaagtcgggacagacctaggagagcgtaggaacggacgaccggcttagttaattagttacgtggtaggggaagtaggggacgacgggtaagttaggggaacggttaggggttgggtacggggcggtaacggggg

SEQ ID NO: 266940 - DNA, 606 bp, Homo sapiens
  misc_feature: GYAE6OF01BL1BW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctctggattcaccttcagtatttatgctatgcacgtgggtcccgccaggcctccgaggggaacgggactaggaatatgtctcgaggtattagaagtatgacgaataacatatattatgactaaactctgtagaagggcagattacaccatctccgaggacaacttaccaagaacacgctgtactcttacaaagtcgggacagtcctagaggacgcgtaggacggaccgacggtcttaggtaattacgtttacggtgggttaggggaaggtaggggtacggtacgggttaaaggtttacggggaaacggtttagggggtttcgggtcggggggacccggtaacgggggg

SEQ ID NO: 266941 - DNA, 639 bp, Homo sapiens
  misc_feature: GYAE6OF01A4SI7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccaggccgtggggggtccctgagactctcctgtgcagcctctggattcaccttcagttatttatgctatgcacgtgggtccgcaggctccgaggggaaggactggaatatgtctcgaggtattagaagtatgacgaataacatatattatgactaaactctaggtagaagggcaagtacttcaacctatcctaccgaagggaactaacttacccgaaagaacgaccgtacttagtacttaccttaacaaagtcgggacaacgcccgtaggaagacgtcgtaggaacggaccgacgggtctagttaattaacgtttacggttagggtaggggaacgggtaaggggaacgggtaacgggttaaaggttacggggaaacggtttaggggggtttcgggtacggggggcccgggtaacggggg

SEQ ID NO: 266942 - DNA, 597 bp, Homo sapiens
  misc_feature: GYAE6OF01DWSGV.28.57.F02.1.454.CMB.1.raw
  modified_base (260)..(260): a, c, t, g, unknown or other
  misc_feature (260)..(260): n is a, c, g, or t
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttagctattttaaaggtgtccagtgtgaggtgcagctggtggagtctgggggagcttggtccagccgtggggggtccctgagactctcctgtgcagcctcnggattcaccttcagtatttatgctatcgcactggtccncaggctcgagggaggctaggatatgtctacaggtatagaagtaactgacgaaataacatataattatgactaaatctaggtagaagggcagtattccaacctactctacccgaagggaacctaagttacccgaaagaaccacgtcctagttactacgttacaaagttcgggactacggcctaggaagcgtcgtggaacggacgacggtctagtacttaattacgtgggttagggaggaacggagacgggtaacgttagggtaaccgttagggggtttcggtcgggggaccgtaacgggg

SEQ ID NO: 266943 - DNA, 585 bp, Homo sapiens
  misc_feature: GYAE6OF01C7L38.28.57.F02.1.454.CMB.1.raw
  modified_base (386)..(386): a, c, t, g, unknown or other
  misc_feature (386)..(386): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggagcttggtccagccgtgggggtccctgagactctcctgtgcacgcctcgtggattcaccttcagttatttatgctatgcacgtcgggtccgccgaggcctcccggaaggggaaggaccgtggaatagtcgtctacgaggttaattagaaagtatgacgaaataacattatattangaacaactgtagagaacggatagtacttacactactcctacgaacggtactaacttaaccaagaacaacgctagtattcctacaaacgtgggtacacgtccagacgagacgtgaaggaccgacggtcgtagtagttattacggtggtaggaggtaggagtaggtagtaggtacgttaggggtggtgggcggtaacgggg

SEQ ID NO: 266944 - DNA, 580 bp, Homo sapiens
  misc_feature: GYAE6OF01B4MNV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtcccgccaggcctccgaggggaagggactggaatatgtctcaggtattagaagtaatgacgaataacatatattatgacaaactctagtaggaagggcagtattccacatcctacgagggtacaactaccaacgaacacgctagtactcttacaagtgggacacgcctgacgagtcgtaggacggacacggtctagtagttattacggtgggtaggggaggagggacggacgggtaagtttacgggaacggttagggggttgggtcgggggccggtaacggggg

SEQ ID NO: 266945 - DNA, 641 bp, Homo sapiens
  misc_feature: GYAE6OF01B9HDO.28.57.F02.1.454.CMB.1.raw
  modified_base (295)..(295): a, c, t, g, unknown or other
  misc_feature (295)..(295): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtctgggggagcttggtccagccgtggggggtccctgagactctcctgtgcagcctctggattcaccttcagtattatgctatgcactgggtccnccaggctccgagggagggactggaatatgtctcgaggtattagaagtaatgacgtaaataacatatattatagactaaactctgtaggaagggcaaggtatttccgaaccctaattccgttacccgaaggggtaaccaaacgtttacccgaaaggaaccaccgtccttagttaacttacctttaacgaaagttcggggacaacggtacccttagggaagtcggacgttagggacgggaccgacggccgttagttaacttattacgtgggtaggggaggagggaacggtacggaaggtttacgggaaacgtttaggggggttcggttacggggggccgtaacggggg

SEQ ID NO: 266946 - DNA, 715 bp, Homo sapiens
  misc_feature: GYAE6OF01B8PHX.28.57.F02.1.454.CMB.1.raw
  modified_base (599)..(599): a, c, t, g, unknown or other
  misc_feature (599)..(599): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctggtggagtcgtgggggaggcgttggtccaggccgtggggggtccctgagactctcctgtgcagcctctggtacttcacctttcagttatttatgctatgcacgtgggtcccgccgaggcctaccgaggggaaggacgtaggaaattagttgtcctacgtaggttaagttaagaagttaatacgaacgtaaaattaacaattaattaatttaagtacgtaactaaaacttcgttaggtaggtaaacgggacaaggttacttacaacctatacccgtaccgaaacgggtaactaaaccgttaaccaaaggaacccacggtactacgttaacttccttaacgaaaggttcggactaacggtcctaggaacgcgtaccgtaagggaaccggtacgtaaccgggtnttacggtaatttaagtacggtttgggacgggtaacggaagggtacgggtaaggttaaacgggttcgggtaaaacgggtttgggggttacgggtacgggggtaccgggtaaccgggg

SEQ ID NO: 266947 - DNA, 575 bp, Homo sapiens
  misc_feature: GYAE6OF01BKHQ4.28.57.F02.1.454.CMB.1.raw
  modified_base (259)..(259): a, c, t, g, unknown or other
  misc_feature (259)..(259): n is a, c, g, or t
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctntggattccaccttcagttatttatgctatcgctactggggtcccnccaggcctccgaggggaaggactggaatatgtctnaggtattagaagtaatgacgaaataacattatattatagactaaactntaggtagaagggcagtattccaacctatcctacgagggaactaattaccgaaagacacgtctagttactctttacaagtgggacagcctgagncgtgagacacggctagtattattcgtgggtaggaggtagggacgtacggtaagttacgggaaacgttaggggttggtcgggggacgtaacggggg

SEQ ID NO: 266948 - DNA, 563 bp, Homo sapiens
  misc_feature: GYAE6OF01B28GT.28.57.F02.1.454.CMB.1.raw
  modified_base (558)..(559): a, c, t, g, unknown or other
  misc_feature (558)..(559): n is a, c, g, or t
  modified_base (561)..(562): a, c, t, g, unknown or other
  misc_feature (561)..(562): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactggtgggagaggaggcggaagttggaacgtaggggttggtggggccgagggacgccgtgggtcaccgtctcctcacgccctccaccgaacgggcccagtccggtccttcccccgtggccgcccctcgccctccgacggacgccacccgtccgagacgccacgacgccggcccgtgggcctcggcccgtgggtaccgaacggtactacttccagtacggcgtacctcgtggcggccgggacgtgggaccgaaggcgcgatagnngnng

SEQ ID NO: 266949 - DNA, 581 bp, Homo sapiens
  misc_feature: GYAE6OF01DL30B.28.57.F02.1.454.CMB.1.raw
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagccgtggggggtccctgagactctcctgtgcagcctctggattcaccttcagttatttatgctatgcacgtcgggtccgccaggctccgaggggaaggactggaatatgtctcgaggttataagataatgacgaataacatatattangacaaatctgtaggaaggcagtacttacactatcctacgaggacaacttaccaagaacacgtctagtatcttacaagtgggacacgtcctagagagcgtgaacggacgacgggtcttagtaattattacggtggtaggggtaggaagggacggtacggtaaaggtttacgggaaacggttggggtttacgggcgggggccgtaacggggg

SEQ ID NO: 266950 - DNA, 566 bp, Homo sapiens
  misc_feature: GYAE6OF01D5E0I.28.57.F02.1.454.CMB.1.raw
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (467)..(467): a, c, t, g, unknown or other
  misc_feature (467)..(467): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggagggactggaatatgtctcgaggtattagaagtaangacgaataacattatattangacaaactctgtagaagggcagattaccaccatcctaccaagggacaacttaccaaagaaccacgctagtatcttacaagtcgggacagcctagagngctggacggacacggtctagtattagttacgtggtaggggagaggaggacggtaaagttcgggaaacgttagggggttcggtgggggccgtaacggggg

SEQ ID NO: 266951 - DNA, 641 bp, Homo sapiens
  misc_feature: GYAE6OF01BS0KH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcacctttcagtatttatgctatgcacgtgggtccgccaggcctccgaggggaagggactggaatagtgtctcgaggtattagaagtaatgacgtaataacataattattatagactaaaactctagtagaaggggacaaggtattaccaacctattccgttaccgaagggtaacctaaacgttacccaaaaggtaacccacgtacctagttacttacgttacaaagtgggacctagacctggaagtacgctaggacgaacgtcggacttaggtattaacgttacgttggggtaggggaaggtacggggtacggtaacgggtaaggtttacggggaaacgtttaggggggtcgggtggggggcccgtaaacgggggg

SEQ ID NO: 266952 - DNA, 582 bp, Homo sapiens
  misc_feature: GYAE6OF01B6L4N.28.57.F02.1.454.CMB.1.raw
  modified_base (254)..(254): a, c, t, g, unknown or other
  misc_feature (254)..(254): n is a, c, g, or t
  modified_base (437)..(437): a, c, t, g, unknown or other
  misc_feature (437)..(437): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtctgggggaggcttggtccagcctggggggtccctgagactctcctgtgcngcctctggattcaccttcagtatttatgctatgccactgggtccgccaggcctcgagggaaggactggaatagtgtctcagtattagaagtaatgacgaataacattatattatgacaaactcgtgtgaaagggcagattacactatctcaggactaattaccaagaacacgtactagtactnttacaaagttcgggacagcctaggagagctagacggacacgggtcttagtattaagttaccgttgggtaggggaagacggggaggtaccgggaaagtttaccgggaaacgtttagggggttcgggtagggggccgtaaacggggg

SEQ ID NO: 266953 - DNA, 706 bp, Homo sapiens
  misc_feature: GYAE6OF01CJ8WR.28.57.F02.1.454.CMB.1.raw
  modified_base (357)..(357): a, c, t, g, unknown or other
  misc_feature (357)..(357): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattccaccttcagttatttatgctatcgcacgtcggggtcccgccgaggcctccgaggggaaggactggaatatgtctgaggtatagaagtangacaataacatatattangacaactctagtagaagggcagtacttcaacctattacctaccgaacgggtaactaaacgttacccgaaaagaacccgacgtaccttaggttaacctttaccgttaacgaaaacggtcggggaacctaacggtacccgttaggaagggtacgttaccgtaggggaacggtaccgaaaccgggttcttaaggttaactttaacgtttaccggttggggttaagggggaaggtaaagggggtaacgggtaaggggttaaaacggttttacgggggtaaaacggttttggggggttttaccgggggacggggggtaaccccgggtaacgggggg

SEQ ID NO: 266954 - DNA, 768 bp, Homo sapiens
  misc_feature: GYAE6OF01DV62Q.28.57.F02.1.454.CMB.1.raw
  modified_base (760)..(760): a, c, t, g, unknown or other
  misc_feature (760)..(760): n is a, c, g, or t
  modified_base (765)..(765): a, c, t, g, unknown or other
  misc_feature (765)..(765): n is a, c, g, or t
  modified_base (767)..(767): a, c, t, g, unknown or other
  misc_feature (767)..(767): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccaggggaagggactggaatatgtctcaggtattagaagtaatgacgaataacatatattatgacaaactctgtggaagggcagtattcaccatctccgaggacaattccaagacacgctgtatcttacaaagtgggacagtcctagagagctaggacggacgacggtctagtaattacgttacgtgggtagggaggagggaggacggtaagttagggtaacgttaggggttgggtacgggggaccgaggggaccgtcccggttagggtaccgtacccggttcttcccgtcgaccggtcccctacccgaaaccggtaaccggggaccctaaacggttcccgggtttacccccgtttccccccggtcggggtccccgtcccccgttcggtccccgttacccgggaacgggtaccgccccgtaccccgtaccggaacggaccgacccgaaccggtaccgggcccgggtccccgtacggggccctaccgggtcccggttacggggtaccgtaaaccggggttacccttaaccgttacccgtaaggtaccggtaccgttacccgtcggttacggggaccgggtacccggggtcggtaccgggaaccggtacgggacccgtacgtaacggtagngtcgngng

SEQ ID NO: 266955 - DNA, 666 bp, Homo sapiens
  misc_feature: GYAE6OF01APPE4.28.57.F02.1.454.CMB.1.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctatttaaaggtgtcagtgtgaggtgcagctggtggagtcgtgggggaggcttgggtccagccgtggggggtccctgagactctcctgtgcagcctctggattcacttcagtatttatgctatgcactgggtccnccaggctccgagggaagggactagggaattanggttctgaaggtattagaagttatagagaaataaatatataatttanagactaactcgtaggtaggaaggtacagtacttaccacgtactacctaccggaaggtaactaacgttaaccgaaacgaaccgtacgttacttacgtacttaccgttaacgtaagtccgggtaaccgacggtaccgtagggaacgtacggtaccgtaacggaaccgggtacgaaccggtacgttacgttacgtagtttacgggtagggttaggggaaggacgggtaacggtaagggtaacggtttacggggaaacggtttaagggggtcgggtacgggggaccgggtaaggggg

SEQ ID NO: 266956 - DNA, 561 bp, Homo sapiens
  misc_feature: GYAE6OF01A6S0M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtcccgccaggcctccgaggggagggactggaatatgtctcaggtattagaagtatgacgaataacatatattatgacaaactctagtgaagggcagattcaccatctcgaggactaataccaaagaacacgctagtactcttacaatgggacagcctagacgagcgtagacggacgacggctagtatagttacgtggtaggggaggtagggaggacgggtaagttcgggaaacgttaggggtttcggtgggggaccgtaacggggg

SEQ ID NO: 266957 - DNA, 610 bp, Homo sapiens
  misc_feature: GYAE6OF01ESBK8.28.57.F02.1.454.CMB.1.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (453)..(453): a, c, t, g, unknown or other
  misc_feature (453)..(453): n is a, c, g, or t
  modified_base (520)..(520): a, c, t, g, unknown or other
  misc_feature (520)..(520): n is a, c, g, or t
  modified_base (550)..(550): a, c, t, g, unknown or other
  misc_feature (550)..(550): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtaggctatttaaagtgtcagtgtgagtgcagctggtggagtntgggggagcttggtccagcctggggggtccctgagactctcctgtgcagcctnttggactttcaccttcagttattttangcttatgcacgtgggttcccgccagggccttccgaggggaacggactaggaatatgtctgaggtattagaagtatagcgaataanatatattanagacaaactntagtagaaggcagtacttacacctaatcgtaccgaagggtaactaacttaacccaaaggaacacctagttntaacttcctttaacgaaagtcgggaacgcgaccgttaggagtacgccgtaggacggaacgaccggtntaggttattaaagttcgtggtaggggacgngggaacggaggttaagttacggaacggttaggggttgggtaacggggcggtaaacggggg

SEQ ID NO: 266958 - DNA, 540 bp, Homo sapiens
  misc_feature: GYAE6OF01ANJBH.28.57.F02.1.454.CMB.1.raw
  modified_base (280)..(280): a, c, t, g, unknown or other
  misc_feature (280)..(280): n is a, c, g, or t
  modified_base (496)..(496): a, c, t, g, unknown or other
  misc_feature (496)..(496): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccgccaggctccgagggaagggctggaatatgtctcgaggtattaagaagtaatgacgaataacataatattatgacaaactctagtgaagggcagatcaccatctcaggacaattaccaagacacgctgtatcttacaatgggcagcctgacgagctggaggacacggctgtaatagttacgtggtagggaggagggacgngggtaagttcgggaacttaggggttggtgggggccgtaaggggg

SEQ ID NO: 266959 - DNA, 619 bp, Homo sapiens
  misc_feature: GYAE6OF01C5ROD.28.57.F02.1.454.CMB.1.raw
  modified_base (265)..(265): a, c, t, g, unknown or other
  misc_feature (265)..(265): n is a, c, g, or t
  modified_base (289)..(289): a, c, t, g, unknown or other
  misc_feature (289)..(289): n is a, c, g, or t
  modified_base (296)..(296): a, c, t, g, unknown or other
  misc_feature (296)..(296): n is a, c, g, or t
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (445)..(445): a, c, t, g, unknown or other
  misc_feature (445)..(445): n is a, c, g, or t
tcagagtacgctatcacgaccggtgctcgatttagctcgatatagttggggtctgggagaggagcccccgccctgggtttcccgaggtgttctcatttggtgatcagcactgccacacagaagagtcatgacggagtttgggctgagcggtggtttcgtcgtaggcgtattttaaaggtagtcagtgtgaggtgcagctggtggagtgtgggggaggcttggtccagccgtggggggtccctgagactctcctgtgcagcctcgnggattcactttcagttatttatgntatgacncgtggtccnccaggctccgagggaagganggaatntgtntacaggtattagaagtaatgacaataacatatattacnacaaactgtgtagaaggcagattcactattcacgaaggactaacttacaagaacacgtctagattcctttanaattacgggctacgacgtacgagagtcgtaggaacggaccacgggtacgttaagtagttaactttaccggtgggttaggggtaaggaaggggttaacggaaccgggttaaagttcccggggttaaaaaggtttgggggtttacggggtaccgggggtcggttaaaccggggggg

SEQ ID NO: 266960 - DNA, 597 bp, Homo sapiens
  misc_feature: GYAE6OF01B7CHW.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtccncaggctccgagggaaggactggaatatgtctcaggtattagaagtatgacgaataacatatattatgactaaactcgtagtaggaaagggtcaagtacttcaaccctatcctaccgaagggtaactaacttaccgaaagaaccacgtcttagtactcttaacaaagtgggacacgtcctaggagtagtctaggacgtacgacggtctagtacttagttacgtgggtagggaggtagggacggacgggtaaagttacggggaacgtttagggggtcggtacgggggccgtaacggggg

SEQ ID NO: 266961 - DNA, 727 bp, Homo sapiens
  misc_feature: GYAE6OF01DVSKT.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttcctgttgcttatttttaaaggtgtccagtgtgaggtgcagctgggtggagtcggtgggggagtcgttggtccaggccggtggggggtccctgacgacttctccgtgtgcacgtcctcgtggtacttccacctttcgagtttatttangtctagtgccacggtcgggtcccaccgacggtccgtaccggaaggggaacggtacgtaggtaattagttcgtacgtacgtaaggttaattaaggaaacgtagtacgaacgtaaataaacgtaattaagttattagtacgaactaaactcgttaggtaggaacggactaaggtacttacccgaactactacgtacgaaaggtaactaacgttaaccgaaagtacctacgtactagttaacctaccgtaagaaggtcggactaacggtccgtaaggacgtacggacgttaggaaccggtaccgtacggtacgtaagttaacttaaggttacgggtaagggtagggaaggtaacggggtacggtaagggttaacggttaaggggtaaccggttaggggttccggggtaacgggggccgtaaaccggggg

SEQ ID NO: 266962 - DNA, 593 bp, Homo sapiens
  misc_feature: GYAE6OF01B3I43.28.57.F02.1.454.CMB.1.raw
  modified_base (304)..(304): a, c, t, g, unknown or other
  misc_feature (304)..(304): n is a, c, g, or t
  modified_base (354)..(354): a, c, t, g, unknown or other
  misc_feature (354)..(354): n is a, c, g, or t
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgcttattttaaaggtgtccagtgtgaggtgcagctggtggagtcgtgggggaggcgttggtccaggccgtggggggtccctggagactctcctgtgcagcctctggacttcaccttcagttatttatgctatgcacgtgggtccncaggctccgagggaggactggaatatgtctacgtaggtattaagaagtangacgaataacatatattanagacaaactctagtaggaacggcagtacttccactagtcctacgaaggactaactaccaaagacacgtcttagtactacttacgaagtgggactagtcgtaggagtagcgtaggacggacgacggattgttagttacgttacggtggtagggaacggtgggacgggtaacggtaaggttagggtaacggttaggggttcgggtcggggccgtaacggggg

SEQ ID NO: 266963 - DNA, 663 bp, Homo sapiens
  misc_feature: GYAE6OF01CL0I4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccaggccgtggggggtccctgagactctcctgtgcagcctctggattccaccttcagttatttatgtctatcgacgtacgtcgggtcccgccgaggcctacccgaaggggaacgggactagggaatagtgtctacgtaggtattaagaagtaatgacgtaaataacatatattatgactaaactcgtaggtagtaacgggctaagtacttaccaacctactcctaccgaagggaacctaacttacccgaaagaaccacgtcttagttactaccttaacgaaagttcgggactacgtccgtaggacgtacgtacgtaggaacggaccacgggtccttaggtaacttacgttaacggtgggtagggaacggtaggtacgggtacgggtaaaggttacggggtaaacggttagggggtttcgggcgggggtacccggtaaggggg

SEQ ID NO: 266964 - DNA, 952 bp, Homo sapiens
  misc_feature: GYAE6OF01D1XCK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgtcttatttttaaaggtgtccagtgtgaggtgcagctggtggagtcgtgggggaggtcgttggtccaggccggttcggggggtccctggacgtacttccgtccgtggtcgccgacgtcccttcgtggtactttccaccctttctaaggttattttagtcgtctagttcgcctacggttcggggtcccgaccgacggccgttacccggaagggggtaaacggtacgttaagggaaatttacgtcggttaccgtacgtaaaggttaacgttaaaggaaacggttaagtacggaaaccgtaaaataaacctaaatttaaattaaatttacgtaacggtaacctaaaacgttcgttaagggtaagggaaacgggtacctaacgttaccgttaacccaacccgttaacgttaccgtaacccggtaaacggggtaaaccccttaaaacgttaaccccgaaaacggaaaccgttaacccggtaccgtttaaacgtttaaacgttaacccgtttaaacccggtaaaacgggttcccggggtaacaaccgggttacccgtaaacgggtaaagggtacccggtaaccggtaacgggtaaaccgggtaccgggtaaacccgggtccggtttaaaggtttaaaccgtttaaccggttttaaccgggtaagggggttaaggggaacggggtaaacgggttaacggggttaaacgggtaaaaccgggttttaaggggttaaacccggggtttaagggggtttacggggtaaccccggggggtaacccggttaaaccggggggg

SEQ ID NO: 266965 - DNA, 674 bp, Homo sapiens
  misc_feature: GYAE6OF01CTM9F.28.57.F02.1.454.CMB.1.raw
  modified_base (403)..(403): a, c, t, g, unknown or other
  misc_feature (403)..(403): n is a, c, g, or t
  modified_base (542)..(542): a, c, t, g, unknown or other
  misc_feature (542)..(542): n is a, c, g, or t
  modified_base (566)..(566): a, c, t, g, unknown or other
  misc_feature (566)..(566): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgcttaatttttaaaggtgtccagtgtgaggtgcagcgtggtggagtcgtgggggaggcttggtccagccgtggggggtccctgagactctcctgtgcagcctctggatttccacctttcagttatttatgtctatcgactacgtcggggtcccgccgaggcctccggaggggaacgggactagggaatagtcgtctcgtaaggtattaagaagttaatgacgtaaataacataattaattancgaacaaacttcgtagtaggaagggactagtaacttaccactaactccgtacgagggtaacctaaacttaccaaacgaaccgcgtaccgttagtacttaccttaacgtaaagttcgggacctaagccggttagaacggngtcgtaggacggacggtaccggtnttagtaacgttacgtacggtggggtaggaacggtaggtaagggtacggttaaggttacggggtaaacggtttaggggggtttcgggacggggtcccgggtaaacgggg

SEQ ID NO: 266966 - DNA, 619 bp, Homo sapiens
  misc_feature: GYAE6OF01COGN9.28.57.F02.1.454.CMB.1.raw
  modified_base (299)..(299): a, c, t, g, unknown or other
  misc_feature (299)..(299): n is a, c, g, or t
  modified_base (369)..(369): a, c, t, g, unknown or other
  misc_feature (369)..(369): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtcccnccgaggctccgaggggaacggactggaatagtgtctcaggtatagaagtatgacgaataacatatattangacaaactctgtagaggcagattcacatctacgaggactaattaccaagacacgtctagtactcttacgaagttcgggactacgcctaggaacgtacgtcgtaggaacggaccgacgggtcgttagtaaattacgtttaaccggtggggttacggggaagggtaaaggggaaggtaccggggttaaaagtttaggggtaaaccgtttagggggggtttcgggtacggggggtacccggtaaacggggggg

SEQ ID NO: 266967 - DNA, 589 bp, Homo sapiens
  misc_feature: GYAE6OF01BKY8P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactggtccgcaggctccgagggaaggactggaatatgtctcgaggtattaggaagtaatgacgaataacatatattatgactaaactctagtaggaacgggcaggtacttccaacctacttcctaccgtaagggaacctaacgttacccaaaggaaccaacgtcttagtacttactttacaaagtcgggacacgccgtagagacgtctaggacggacgacggcttagtatagttacgtggtagggaggaggacggaggtaagttagggaacgttagggttgggtcggggcggtaacgggg

SEQ ID NO: 266968 - DNA, 662 bp, Homo sapiens
  misc_feature: GYAE6OF01DA58Y.28.57.F02.1.454.CMB.1.raw
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctgggtggagtcgtgggggaggcttggtccagccgtggggggtccctggagactctcctgtgcagcctctggattcaccttcagttatttatgctatgcacgtgggtcccnccagctcccgagggacgggactaggaatagtgtctcgaggttatagaagtatgacgaataacattataagttatgacgtaaacttcgtagtaggaaggcagtactacactactcctacgaacgggaactaacgtacccgaaagaacctacgacgttacgtacgttaccttaactaaacggttgggaacgtacgtaccgtacgaaggtacgacgttacggaacgggacgtaccgggtacgttacgttagtttaaacgtacggttagggtaaggggtaaggagggtaacgggaacgggttaaacggttacggggtaaaggttagggggtttacggggtacgggggtaccggtaaccgggggg

SEQ ID NO: 266969 - DNA, 573 bp, Homo sapiens
  misc_feature: GYAE6OF01DPPGT.28.57.F02.1.454.CMB.1.raw
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatcgcacgtcgggtccnccaggcctccgaggggaacgggactgggaatatgtctacgaggtaattagaagtaatgacgaataacatatattangacaactntgtagaggcagattcacctatcacgaggacaacgttaccaagacacgtctagtactcttanaagtcgggcaagcctagagngacgtggacggaccncggtctagtacttagttacgtgggaggggagaagggacgagggttaaagttcgggaaacgttggggttacgggtcggggcgtaacggggg

SEQ ID NO: 266970 - DNA, 681 bp, Homo sapiens
  misc_feature: GYAE6OF01CX5K9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggaggcgttggtccagccgtggggggtccctggagactctccgtgtgcacgcctcgtggtattcaccttcagttatttatgctatgcacgtcggtccgccaggcctaccgagggaacggactaggaatagtgtcgtacgtaaggttattaaggaaagttaatgaacgtaaataactaattaataattatacgaactaaaacttcgtaggtaggaaaggctaagtacttaccaacctacgttacctaccgaagggtaaactaacgttaaccgaaacgtaaccacgtactagtacttaccttaacgaaagtcggacgtaacgccgtaggaaggactacggtgaacggtacgaccggtataggttaaacttaacgttacggtagggtaggggtaggaacgggtaacggacggttaaaggttacggggtaaacggttagggggtttacggtacggggggtaccggtaaaccggggg

SEQ ID NO: 266971 - DNA, 694 bp, Homo sapiens
  misc_feature: GYAE6OF01CW8U3.28.57.F02.1.454.CMB.1.raw
  modified_base (421)..(421): a, c, t, g, unknown or other
  misc_feature (421)..(421): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtgggttttccttgttgcttatttttaaaggtgtccagtgtgaggtgcagctggtggagtcgtgggggaggcttggtccaggccgtggggggtccctggagactctcctgtgcagcctctggattcaccttcagttattttatgcttatgacctacgtcggggtccgcccgacgggtcctaccggaggggaacggacgtagggtaattagtgttctacgtaggttaattaaggaaagttaagtgaacggaaaataaacctaattagttaatttanagtaactaaacttcgttaggaggaaacgggctaagtaactttaccgaccctaagtcctaaccgaagggtacctaaacttaaccgaaagaactacgtctaagttacttaccttaacgaaagttcgggactaacgccgtaagacggtacgacgttagaacggtcgtaacggtcttaaggtattagtacggtagggtagggaaggagggaacggtacggtaaaggtttcgggaaacgggtttagggggttacgggtcgggggtaccggtaacgggg

SEQ ID NO: 266972 - DNA, 930 bp, Homo sapiens
  misc_feature: GYAE6OF01EZ3WR.28.57.F02.1.454.CMB.1.raw
tcagagtacgctatcacgaccggtgctcgatttagctcgatatagttggggtctgggagaggagcccccgcccctgggtttcccaggtgttctcatttggtgatcagcacctgcacacagaagagtcatgacggagtttgggctgagctgggttttccttgttgtctattttaaaggtgtccagtgtgaggtgcagctggtggagtcgtgggggaggcttggtccaggccgtggggggtccctgacgactctcctgtgcgagcctcgtggtacttcaccttcagttatttatgtctatcgctacgtcggggtacccgaccgagggtcctaccggaagggggaacgggtacgtagggaaacttaagttcgttacctaccgtaagggttaatttaaggtaaagttaacgttacggaaccgtaaaacgttaaacgtaagtttaattaaacgttttaagtacggtaaccttaaaaaccgttccggttaggtaacgggtaaaacgggtaccgtaaaggtttaacttaaccccgtaaacctaacgttacccgttaacccggtaaacggggtaaaccctaaacgtttaaccccgaaaaccggtaaacctaacccggtacgttaacggtttaaccgttaccgtttaaaccgttaaaacgggttcgggtaacccgttaaccggtacccgttaacgggtaaggtaaacggttaacccgttaaagggaacccggggtaaccgtaacccggggttaccgtttaaggtttaaccgtttaaacggttttaaacccgggttagggggttaaacggggggtaaagggtaacggggggtaacgggtaaaccggggtttaaaacggtttaccgggggttaaaaacggggtttaacgggggggtttacgggggttaaccggggggtaaccccggggttaaaccgggggg

SEQ ID NO: 266973 - DNA, 817 bp, Homo sapiens
  misc_feature: GYAE6OF01DWHZP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacgggtaggtttgggctggagtcgttgggttttccttgttgtcttaagtttttaaaggtgtccaggtggtggaggtgcagcgtgggtggaggttcggtggggggaggtcgttcgggtcccgaggtcccgggttcggggggggttcccctagggtacgtacccgttccgttcccgttggtcggccgacggtcccgttcggttggtactttcctaccctttacgaggtttattttagtcgtacttagtcgccgtaccggttcgggggtccccgaccgtacgggtcccgtaccggaagggggaacgggtacgtaaggaacttagtgttaccgtaggtaaggttaattaaacgggtaaagttaaagtacgaaacgtaaaattaaaacgtattaattaaattacgtacggtaacctaaccgttcgtaggtacggaaacggtctaaggtacttacccaaccgtacgtcccgtaacggaacggtaaacctaaccgttaacccgaaaacggaacccgtacgttacgttaagttaccttaaccgttaacgaaacggttcgggactacggtcccgaagacgggtacgtacgtaggacgtacgtacggtataggttaattgtacggtggggaggaggagggtacggtaagtacgggttacgggtagggttaggggttaggggccggtcccgggtaagggg

SEQ ID NO: 266974 - DNA, 658 bp, Homo sapiens
  misc_feature: GYAE6OF01C3R91.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggagcttggtccagccgtgggggtccctgagctcgtcctgtgcacgtcctacgtggaacttccaccttcaggttattatgctatcgcacgtggtccgcgaggctaccgaagggaggactaggtaatagtgtactcgtaaggttagttaagaagtaagtaggaccgaaaagtaactaattaataattaatcgaactaaaacgtcgtaggtaacggaacgggacaacggtattaccgtaacctactacgtaccgaacggtaacctaacgttaaccgaaagaaccgaccgtacgttacgtacttacttacgaaattcgggactagaccgtggaagtagacgttagacggacgtacggtctaagtacgtacgttacgtacggtagggaacggtagggtacgtacgggtaagttacgggaacgggttagggttggtccggggacgtaacggggg

SEQ ID NO: 266975 - DNA, 676 bp, Homo sapiens
  misc_feature: GYAE6OF01A2UGS.28.57.F02.1.454.CMB.1.raw
  modified_base (279)..(279): a, c, t, g, unknown or other
  misc_feature (279)..(279): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (383)..(383): a, c, t, g, unknown or other
  misc_feature (383)..(383): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctattttaaaggtgtccagtgtgaggtgcagctggtggagtcgtgggggagcgttggtccagccgtggggggtccctgacgactctccgtgtgcgagcctcgtggacttccaccttnagttatttangctatgctacgtcggtccnccgaggcctaccgaggggaacggactaggaatagtgtctacgagtattagaagtatgacgaataacatatattangtactaaactcgtagtaggaacggctagtacttaccaacctagttccgtaccggaagggtaacctaacttaccgaaagacctacgtcttagtaacttcgttaacgaacgtcgggtacacggtcccgtaggacgtacggtactacgggaacggaccgtacgggtacctttaggttaacttacgtttacgggtgggtaagggaacgggtaagggtaccgggtaacgggttaaaggtttaccggggtaaacgggtttagggggttcgggtaccgggggtaacccggtaaccggggg

SEQ ID NO: 266976 - DNA, 557 bp, Homo sapiens
  misc_feature: GYAE6OF01CG2FM.28.57.F02.1.454.CMB.1.raw
  modified_base (304)..(304): a, c, t, g, unknown or other
  misc_feature (304)..(304): n is a, c, g, or t
  modified_base (376)..(376): a, c, t, g, unknown or other
  misc_feature (376)..(376): n is a, c, g, or t
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggattccaccttcagttatttatgctatgcactgggtcccncaggcctccgagggaaggactggaatagtgtctacgaggtattaagaataatgacgaaataacatatattangacaaactntagtagaaggcagtatacacatctacgaggactaactaccaagaacacgctagtactcttacaagtggacagacctagagagtctaggacgacgacgctagtattattacgtggtagggagaaggaggaggtaagttaggaaacggttagggttacgggtgggcgtaacggg

SEQ ID NO: 266977 - DNA, 621 bp, Homo sapiens
  misc_feature: GYAE6OF01BP13Q.28.57.F02.1.454.CMB.1.raw
  modified_base (464)..(464): a, c, t, g, unknown or other
  misc_feature (464)..(464): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtcagtgtgaggtgcagctggtggagtcgtgggggaggcttggtccagccgtggggggtccctgagactctcctgtgcagcctctggattccaccttcagttatttatgtctatgcacgtgggtcccgcaggctccgaggggaacgggactggaatagtgtctcgtaggtattaagaagtatggacgaaataacattaattattaatgactaaactcgtagtaggaagggcaaggtacttccaacctattccgtaccgaagggtaacctaattacccgaaagtaaccncgtacctagttactcttaacgaagtgggacacgtaccgtgacgngcgtggaaggaccgacgggcttagttattaacgttacgtgggtagggaggagggagtacggtaaaggttacgggtaacggtttaggggttcggggtacggggcggtacggggg

SEQ ID NO: 266978 - DNA, 694 bp, Homo sapiens
  misc_feature: GYAE6OF01EHH2P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggacttccaccttctagttattttatgctatgcacgtgggtcccgcaggctaccgaggggaggactaggaatatgtctgaggtattaagaagtaatgacgtaataacatattattatgactaaactcgtaggtaggaaagggctaagtacttacccaacctacgttccctaaccggtaagggaacctaaacgttaccgaaaacgaaccgtaccgtacgttaacgtttacttactttaacgaaaggttcgggaacacggtccgttaggaagtacgtacgttaagggaacgggaaccgtaccgggtactaggttaaacttaggtttaacggtggggttaggggaaggtaacggggaaggtaacgggttaaaggtttacgggggtaaacggtttaggggggtttacgggtccggggggtaccgggtaaaccggggg

SEQ ID NO: 266979 - DNA, 609 bp, Homo sapiens
  misc_feature: GYAE6OF01D0BNQ.28.57.F02.1.454.CMB.1.raw
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggagcttggtccagccgtggggggtccctgacgactctcctgtgcagcctctggattcaccttcagtatttatgctatgcacgtcgggtccncgaggctccgaggggacggactggaatatgtctacgagttatagaagtatgacgaataacatatattangacaaactcgtagtaggaaggacagtacttacacctatcctaccgaggtacaacttaccaaacgacacgtcttagtacttaccttagaaacgttcgggactaacgtccgtaggagcggtccgtagggacgaccgacggtacttagtacttagtttacgtgggtaggggagaagggaggacgggtaaagtttcggggaaacgtttgggggttacgggtcggggtacgtaaccggggg

SEQ ID NO: 266980 - DNA, 639 bp, Homo sapiens
  misc_feature: GYAE6OF01A76Z6.28.57.F02.1.454.CMB.1.raw
  modified_base (346)..(346): a, c, t, g, unknown or other
  misc_feature (346)..(346): n is a, c, g, or t
  modified_base (523)..(523): a, c, t, g, unknown or other
  misc_feature (523)..(523): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtcgtgggggaggcgttggtccaggccgtggggggtccctgagactctcctgtgcagcctctggattcacctttcagttatttatgtctatgctacgtcggggtcccgccaggcctccgaggggaagggactggaatatgtctnaggtattagaagtaatgacgaaataacattaatattaatgactaaactctagtagaaggtcagtacttacacctatctaccgaaggaactaacttaccgaaagaaccacggtctagtacttactacgaagtgggacacgtacctaggagacgtcgtaggaacggtaccgaacgggtntacgttagttaacgttacgtagggttaggggaaggtaacggggtacgggaccgggttaaaggttacgggtaaacgggttaagggggtttcgggacggggggaccgtaaacgggggg

SEQ ID NO: 266981 - DNA, 652 bp, Homo sapiens
  misc_feature: GYAE6OF01BGJ9O.28.57.F02.1.454.CMB.1.raw
  modified_base (255)..(255): a, c, t, g, unknown or other
  misc_feature (255)..(255): n is a, c, g, or t
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (440)..(440): a, c, t, g, unknown or other
  misc_feature (440)..(440): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctgggtggagtcgtggggggaggcttggtccagccgtgggggggtccctgagctctcctgngcagcctctggattccacctttcagttatttatgctagtgctacgtcgggtccnccgaggtcctaccgaggggaagggtactaggaatagtgtcctagtaggtaatttaggaaagttactgacgaaataanaattatagtttaangacaaacttgtgtaggaacgggtcaagtacttaccaactnttaccgccgaaagggtaactaacgttacccaaaggaaccaccgtacgttagtactttacgtaaccgaaaggtccggggaacacgtaccgtagacgacgtacctagggacggaacgcccggtntagttattaccgttggtgggtaggggaggaggtcggtaaggtaaggttagggtaaacggttaggggttcgggtgggggactaacgggggg

SEQ ID NO: 266982 - DNA, 555 bp, Homo sapiens
  misc_feature: GYAE6OF01BQ57U.28.57.F02.1.454.CMB.1.raw
  modified_base (371)..(371): a, c, t, g, unknown or other
  misc_feature (371)..(371): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttcagttatttatgctatgcactgggtcccgccaggcctccgaggggaaggactggaatatgtctcaggtattagaagtaatgacgaaataacatatattangacaaactctgtagaaggcagattcacatctccgaggaacaacttacaagaacacgctgtatcttacaagtggcagctagagagctagacggacgacggtntagtattattacgtggtagggaggaggacggaggtaaagtttagggaacgttaggggttcggtacgggggtccgtaacggggg

SEQ ID NO: 266983 - DNA, 572 bp, Homo sapiens
  misc_feature: GYAE6OF01BLWAY.28.57.F02.1.454.CMB.1.raw
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagccgtggggggtccctgagactctcctgtgcagcctctggattcacctttcagttatttatgcttatgcacgtgggtcccgccagggcctccgagggaagggactggaatatgtctcgaggttataagaagtaatgacgaataacattatattangacaaactctgtagaaggcagtatcaccatcctacgaggacaattcaaagacactctagtactcttacaagtggcagcctagagagcgtaggacggacacggtctagtatacgtttacgtgggtagggaggtaagggacgtaagggtaattacggggtaacggttagggttcgggtcgggggccgtaacggggg

SEQ ID NO: 266984 - DNA, 828 bp, Homo sapiens
  misc_feature: GYAE6OF01E4HGA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtccatgacggtagtttgggcctgagcttgggttttccttgttgcttagttttaaaggtgtccagtgtgaggtgcagcgtggtggagtcgtgggggaggtcttggtccaggccggtggggggtccctgacgactctccgtgtcgcagcctcgtggacttccacctttctaagttatttagtgtcttatgcctacgttcgggtcccgccgacggccgttacccggaagggggaacgggtaccgtagggtaattacgtcgttacctacgtaaggttaattaaggtaaagttaagtggaaccgtaaaattaaaccgtaatttaatttaatttaacgtacggtaaaccttaaaaaccgttcgtttaagggtaacggaaacgggtacctaaggttaacctttacccgaacccttaacgttacccgtacccgggtaaaacgggtaaaccttaaaccgtttaacccgaaaaacggtaaccccgtaaccggttaccgtttaaacggtttactttaacccgttaaaccgtaaaagggtttccggggaacgtaccggtacccgtaggaaccggtacgaccggttaaggaacggaccgtacggtcttagtaacttacgtttagggacgggttaggggaaggtagggaggtaaccggttaaaggttaacggggtaaacgggtttaggggttcggggtaacgggacccggggtaacgggg

SEQ ID NO: 266985 - DNA, 581 bp, Homo sapiens
  misc_feature: GYAE6OF01EQUAR.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccncaggctcgagggaaggctaggatatgtctcaggtattagaagtaatgacgaaataacatatattatgactaaactcgtagtaggaagggcaagtacttacaacccattcctaccgaagggaacctaaacttaccaaaagaaccaacgtcttagtactacttacaaagtgggacagtccctagagacgcgtaggaacggaccacggcttagtattaagttacgtggtagggagagggacgacgggtaaattgggaacgttaggggtcggtggggccgtaagggg

SEQ ID NO: 266986 - DNA, 700 bp, Homo sapiens
  misc_feature: GYAE6OF01EQ4K7.28.57.F02.1.454.CMB.1.raw
  modified_base (303)..(303): a, c, t, g, unknown or other
  misc_feature (303)..(303): n is a, c, g, or t
  modified_base (685)..(685): a, c, t, g, unknown or other
  misc_feature (685)..(685): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcgttggtccagccgtggggggtccctgagactctcctgtgcagcctctggacttcaccttcagttatttatgctatgcacgtcgggtcccnccgaggcctaccggaggggaacggacgtaggaatactcgtctacgtaaggtattaaggaagtaatacgacgtaaaataaacgtaattaattaattactacggaaccttaaaacgtcgttaggtaacggaaacggggtcaacggttacttacccaaccgtaactacccgtaccggaaacgggtaacctaaacgttaacccgaaagtaacctaccggtcgttaacgttaacttacctttaacgaaacggtcggacctaacggtcctagggacgacggtcgtacggaacgggtacgacggtcgttaagttacgtaactttacgggtaggtaggggaaggtacgggaggtaacgggttaagtacgggtaaaggtggggttacgggngggccgtaacggggg

SEQ ID NO: 266987 - DNA, 632 bp, Homo sapiens
  misc_feature: GYAE6OF01DFW36.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtggggggtccctgagactctcctgtgcagcctctggattcaccttcagttatttatgctatgctacgtcgggtcccgccgaggccgtccgaaggggaagggactagggaatatgtctcgaggtattagaagtatgacgaataacattatattatgactaaactctagtaggaaggcaagattaccactacttcctaccgaacgggaacctaaacttaccgaaaggaaccacgtacttacgttaacttacctttaacgaaagttcggggactacggccctaggtacgagcgtagacggacgacggtcttagtatacttacggtaggtgggaagtcgggaacgggacggttaaaggttacggggtaaccggttaggggtttcggggtcggggggccgtaacgggggg

SEQ ID NO: 266988 - DNA, 834 bp, Homo sapiens
  misc_feature: GYAE6OF01BDGFB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtgggagtcggtgggggaggtcgttggtccaggccggttcgggggggttcccctggacgtacctcctccgtggtcgcgtacgtcccttcgtggtacttacctaccctttactagtttaattttatgtactagttgcctacggttcggggtcccgaccgaacggtcccgttaccgggaagggggaaacgggtacgtaggtaattacgtgttacgtacgtaaggttaagttaaggaaagttaatacggaacgtaaaactaaacgaatttaattaattaagtacgtaacctaaacgttcgttaggtaaggaagggtacaaggttaactttaccgaacctaacgtttacccgtaccggaaacgggtaaccttaaaccgttaaacccgaaacgtaaacccgtaccggtaccgtttaaggttactttacccgttaaacgaaacggttcggggaactacccggtaccgttagggaagtaccggtacgttaacgggaacggtaaccggtaacggtacgttaggttaacttaacggtttacggtagggttaggggaagggttaacgggacgggtaaacgggtaagtttaacggggttaaacgggttaggggtttcgggtaacccggggggcggttaaaccgggggg

SEQ ID NO: 266989 - DNA, 572 bp, Homo sapiens
  misc_feature: GYAE6OF01AYOKL.28.57.F02.1.454.CMB.1.raw
  modified_base (155)..(155): a, c, t, g, unknown or other
  misc_feature (155)..(155): n is a, c, g, or t
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (414)..(414): a, c, t, g, unknown or other
  misc_feature (414)..(414): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgttcgtntagctatttaagtgtcagtgtgaggtgcagctgggtggagtcgtgggggagtcttggccagccggtgggggtccctgagtctcctccgtgngcagcctcgtggtattcaccttnagtatttangctatgctcgtcggccacgcggctccggaaggggaaggctaggaatgtcgtctagagtagttaagagttaagcggataaataacattactaattagacgaactaaactcgtagtaggaaggtacaatactacactntccgacgaggaactagtacaacacgactacgtatactctaacgtaagtcgggactacgctaggacgtagacgtagacggaccgtaggtctagttatacgttgtgggtaggaggaggaccgtaggtagtaggtaggtaggggttggcgggcggtacggg

SEQ ID NO: 266990 - DNA, 728 bp, Homo sapiens
  misc_feature: GYAE6OF01CK6UQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctgggtggagtcgtgggggaggcgttggtccaggccgtggggggtccctgagtctctcctgtgcagcctctggtacttccacctttcagttatttatgtctatgcctacgtcggggtcccgccgaggtcctaccggaagggggaacggtacgtagggtaaattagtcgtactacgtaaggttaattaaggaaagttaagtgaacgtaaataaacattaattattatacgaactaaacttcgtaggtaggtaagggactagtacttaccaacctacgttacctaccggaaggtaacctaacgttaacccgaaagtaaccacgtacttagttaacttaccgtttaagaaacggttgggactacggtaccgtaggaacgtacgtcggtaggaacggtaccgtaacggtaccttagttaaagttacgtttaacggtgggttaagggggaacggtaaggggtaacggtacggggttaaaggttacggggtaaacgggtttagggggttacgggtaccggggggaccgtaacgggggg

SEQ ID NO: 266991 - DNA, 647 bp, Homo sapiens
  misc_feature: GYAE6OF01A7B5L.28.57.F02.1.454.CMB.1.raw
  modified_base (374)..(374): a, c, t, g, unknown or other
  misc_feature (374)..(374): n is a, c, g, or t
  modified_base (453)..(453): a, c, t, g, unknown or other
  misc_feature (453)..(453): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctattttaagtgtcagtgtgagtgcagctggtggagtcgtgggggagcttgggtccagccgtggggggtccctgacgactctcctgtgcagcctctggattcaccttcagtatttatgctatgcacgtcgggtcccgccgaggctccgaggggaagggactagggaatagtgtctacgaggttatagaataagtgacgaaataacattaatattanagactaaactgtaggtaggaacgggctaagtcttaccaacctagtccctacggaacggtaactaacgttaacccgaaanaacccgtacgtactacgttaataccctttaagaaagttcgggacctaacggcctaggaacgtacgcgtacggaacggtaccgaggcctttagtacgttagttaacgtggggtagggaacggtagggtaacggaacggtttaaggtacggggtaaaccggttaggggttcgggtccgggggaaccggtaacgggg

SEQ ID NO: 266992 - DNA, 619 bp, Homo sapiens
  misc_feature: GYAE6OF01AOWW5.28.57.F02.1.454.CMB.1.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattccaccttcagttatttatgctatgcacgtgggtcccgccaggctccgaggggaaggctggaatatgtctcaggtattagaagtangacgaaataacattatattangactaaactntggtagaagggcagtacttcacactctacgacggaactaacgttaccgaacgaacgaccgtctacgtacttacttacgtaagtcgggacacgtccgtaggagtacgacgtaggaacggaccgacgggtcgttagttattaacgttacggtgggtaggggaaggtaggggaacggtacgggttaaaggttacgggtaacgggttaggggttcggggtcgggggaccggtaacggggg

SEQ ID NO: 266993 - DNA, 730 bp, Homo sapiens
  misc_feature: GYAE6OF01EG7BW.28.57.F02.1.454.CMB.1.raw
  modified_base (576)..(576): a, c, t, g, unknown or other
  misc_feature (576)..(576): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtctattttaaaggtgtcagtgtgaggtgcagctggtggagtcgtgggggagtcttggtccaggccggtcgggggtccctagacgactctccgtgtcgcgacgcctcgtggtacttccgtacctttcgtaagtttaattttagtcgtctagtcgcctacggttcggggtcccgaccgacgggccgttaccggaacggggtaacggtacgtaggaacttagttcgtacgtacgtaaggttagttaaggtaaagttacgtaggaacgtaaataaacgtaattattaagttactacgtactaaaccgtgttaaggtaggaagggtactaagtactacccgtaacctacttacccgacggtaaacggtaactaacgttacgaaaccgtacacgtactagttactactaacgagtcgacncgtacgagacgtacgacgtagggaccgacgaccggtagttacgttaaacgttacgtacggtgggttaaggggaacggtaacggtaggggtaacggttaagttaccgggggtaaggtttagggggttcgggtaccggggaaccggggtaacgggg

SEQ ID NO: 266994 - DNA, 611 bp, Homo sapiens
  misc_feature: GYAE6OF01E2C3Q.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcgttggtccagccgtggggggtccctgagactctcctgtgcagcctctggacttcaccttcagttatttatgtctatgccacgtcggggtcccgccgacggcctccgaagggggaagggacgtggaatagtgtctcgtaggtattaagaaagttatacgacgtaaataactattaataattatagactaaactcgtggtagagggacaagtacttcccactatcctacgagggtaacctaactccaaagacacgctagtactacttacaagtgggcaagccgtagacgagacgtaggacggtaccgacggtctaggttaactagttacggtggtacggggagagggcgtaaggtacgttagggaacggttaggggttcgggtcgggaccggtaacgggg

SEQ ID NO: 266995 - DNA, 597 bp, Homo sapiens
  misc_feature: GYAE6OF01CECMO.28.57.F02.1.454.CMB.1.raw
  modified_base (310)..(310): a, c, t, g, unknown or other
  misc_feature (310)..(310): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
  modified_base (519)..(519): a, c, t, g, unknown or other
  misc_feature (519)..(519): n is a, c, g, or t
  modified_base (535)..(535): a, c, t, g, unknown or other
  misc_feature (535)..(535): n is a, c, g, or t
  modified_base (546)..(546): a, c, t, g, unknown or other
  misc_feature (546)..(546): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttgggtccaggccgtggggggtccctgagactctcctgtgcagcctctggacttccacctttcagttatttatgctatgcacgtcggggtcccnccgaggcctccggaaggggaacgggactaggaattagtgtactagtaaggttaattaaggaagtaatgacgtaaataacattaatattatgaactaaacttctaggtaggaagggcagtattccactatcacgaggaactaactaccgaanacacgtnttagtactcttanaagtggacacggcctagagcgtcgaggacggacacggnttgttaatattacggngggtagggagnggaggtacggtaagttagggaacggttaggggtcggcggggacgtacgggg

SEQ ID NO: 266996 - DNA, 699 bp, Homo sapiens
  misc_feature: GYAE6OF01C59U3.28.57.F02.1.454.CMB.1.raw
  modified_base (174)..(174): a, c, t, g, unknown or other
  misc_feature (174)..(174): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggngtccagtgtgaggtgcagctggtggagtctgggggaggcttggtccagccgtggggggtccctgagactctcctgtgcagcctctggattcaccttcagttatttatgctatgctacgtgggtccgccgaggcctccgaggggaaggactggaatagtgtctcaggtattagaagtatgacgaaataacattataatttanagtaccaaacgttcgtaggttaggaacgggacagtacgttaccaacccgtaattaccttacccggaaggggtaaacctaaacgtttaacccgaaacgaaacccgtacgtacgttaacgttacttaccgtttaacaaaagttcggggactaaggtccctagggtaacgaggacgttacggaacgggtacgaccggggtacgttaggtaacttagttaaccgttggggtaggggacgggtaaggggaacgggtaacgggtaaaggtttacggggtaaacgggtttaggggggtttacgggtcgggggggtaccggtaaccgggggg

SEQ ID NO: 266997 - DNA, 671 bp, Homo sapiens
  misc_feature: GYAE6OF01EWSQF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagtatttatgctatgcactgggtccgccaggctccgagggaggactggaatatgtctcaggtatagaagtatgacgaataacatatattatgactaaactcgtagtaggaaagggcaagtattccgaacctatccttacccgaagggaacctaagttaccaaagaacctacgcttagtacttacttacaaagttgggacaacggtcctaggaacgtaggtcttacgggaaggtaccgacgggtaccgttaggttaaacgtttaacgttttaaccggttgggttaggggggaaacgtagggggtaaacgggtaccgggggtttaaaaggtttacgggggtaaaccggttttaaggggggtttggggttaccgggggggtaacccggtaaaccgggggggg

SEQ ID NO: 266998 - DNA, 689 bp, Homo sapiens
  misc_feature: GYAE6OF01AC0I3.28.57.F02.1.454.CMB.1.raw
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagccttctggattccaccgttcagttatttagtgctagtgccgtacgtggggtcccgccgaggcctccgtaggggaagggtctgggaatactgtcgtacaggtatagaagtatcgacgaataacagtatattangacaaactcgtgtaggaacgggactagtactttaccgaaccctagttccgtacccggaaagggtaacctaaacgttcccgaaaaggaaccctacggttctacgtttactacctttacgaaaggtccgggtcaccggtacccgttaggaagggttaccgcggtttaacggaacgggtaacccgacgggttaccttagggttaaactttacgtttaaaccggtggggaccggggttaaggaggacgggttaaacgtagtttacgggaacgggttagggttccgggtacggggccggtaaagggg

SEQ ID NO: 266999 - DNA, 612 bp, Homo sapiens
  misc_feature: GYAE6OF01C8OBM.28.57.F02.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctctggacttcaccttcagttatttatgctatgcacgtcgggtccncgacggctccgaggggaacggactggaatgtgtctagaggtatagaatatgacgaatacatatattangacaatntgtagaggcagtatacactatctacgaggactaactaccaagaacacgtctagtacttacgtacaagtggacagccgtagacgtagcgtaggaacggacgtaccggtacgttagtaactttaacgttacggttgggtagggggaaggtacggggtaaacgggtacgggttaaagggttacgggttaaacgggttaggggggtttgggtaccggggggaccggtaaacgggggg

SEQ ID NO: 267000 - DNA, 728 bp, Homo sapiens
  misc_feature: GYAE6OF01CS9TV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccaggccgtgggggggtccctggagactctcctgtgcagcctctggacttcaccttcagttatttatgctatgctacgtgggtcccgccgacggcctccgaaggggaacggacgtaggaatagtgtctacgaggtattaagaagtaatgacgaaataacgaattaataatttatacgtaactaaacgttctaggtagaacgggactagtaactttacccaaccgtattacccgtacccggaagggtaacctaaagttaacccaaaggtaacccacggttacttagtacttaccgttaacgaaagttcggggactacgacccgttaggaacggtacgtacgttaggaacggtaccgtaaccgggtactttaaggtaaactttacggtttaacggtacggggttaagggggaaggtaaacggggtaacggtaacggggttaaagtttacgggggtaaaaccgggtttggggggtttaccggggaggggggtaaccccgtaaacgggggg

SEQ ID NO: 267001 - DNA, 556 bp, Homo sapiens
  misc_feature: GYAE6OF01DBJ1V.28.57.F02.1.454.CMB.1.raw
  modified_base (526)..(526): a, c, t, g, unknown or other
  misc_feature (526)..(526): n is a, c, g, or t
  modified_base (553)..(556): a, c, t, g, unknown or other
  misc_feature (553)..(556): n is a, c, g, or t
tcagagtacgctatcacgaccggtgctcgatttagctcgatatagttgggtttgggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattacgtggtgggaggaggaggacggaagttagggaactaggggttgtggggccaggggacgcccgtgggtccaccggtctcctcacgcctccaccaagggccccatccggtcttcccccgtggccgcccctgcctccgaggacgccacccgtcgacgacgccacacggccggcccgtgggcctcggcccgtgggtaccaaggtaccctacttccgaatacggtccgtactcgngacgtcgggctgggacaggcgcatagnnnn

SEQ ID NO: 267002 - DNA, 617 bp, Homo sapiens
  misc_feature: GYAE6OF01DIGFK.28.57.F02.1.454.CMB.1.raw
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtggggggtccctgagactctcctgtgcagcctctggattccaccttcagttatttatgctatgcacgtcggggtcccgccgaggcctccgaaggggaaggtctaggaactagtgtactcgaaggtattaaggaagtaatgacgaaataacatataattanacgacaaactctgtagaagggcagattcacatcaccgaaggactaataccaaagaacacgcttagtacttacctagtaaagtcgggacaagtaccgtagaacgtgacgtacggaaggaccgaacggcttagtaacgttaagtacgttagggtaggggaaggtagggtaaggacgggtaaagttacgggtaaacggttaggggttacggggtggggacccggtaacggggg

SEQ ID NO: 267003 - DNA, 602 bp, Homo sapiens
  misc_feature: GYAE6OF01AMZ9Q.28.57.F02.1.454.CMB.1.raw
  modified_base (489)..(489): a, c, t, g, unknown or other
  misc_feature (489)..(489): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattcacctttcagttatttatgctatgcacgtgggtcccgcaggcctccgaggggaagggactggaatagtgtctcgaggttattaagaagttaatgacgaataacatataattatagaccaaactctaggtaggaacgggcagtattccaacctatcctacccgaagggtaaccaattacccaaagaccacgctagtactcttacaagtgggacacgtctgagngcgtaggacgacgacggtctagttaatacgtttacgtggggggtagaggagggtacggacgggttaagttacgggtaagggttaggggttcgggtcgggggccgtaacggggg

SEQ ID NO: 267004 - DNA, 653 bp, Homo sapiens
  misc_feature: GYAE6OF01CCA7P.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtgggggtccctgagactctccgtgtgcagcctcgtggtacttccacccttcaagtttatttatcgtcttatcgccacgttcggggtccccgccgaggcccgtccgaaggggaacggactagggaattagtgtctacgtaggtattaagagtaagtgaacgaaataacattataattatacgactaaactcgtagtaggaacgggctaaggtacttacgacctagttccgtacgaaggtaacaacgttaccaaagtaacacgcttagtacttcgttaacgaagtcgggactacgtaccctaggaacgacgtaccgtaggaacggacctacgggtacttaggtacttagttacgttgggagggtaaggacgggtagaacgggttaagttagggaaacgtttaggggttcggacggggccgtaagggg

SEQ ID NO: 267005 - DNA, 624 bp, Homo sapiens
  misc_feature: GYAE6OF01EVKM2.28.57.F02.1.454.CMB.1.raw
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtccncaggcctccgaggggaaggactaggaatatgtctcgaggtattagaagtatgacgaataacatatattangactaaactntagtagagggcagtatcacatctacgaggactaacgttaccaagaaccacgtactagttactacttacaagttcgggacacgccgtaggagtacgtcgtaggacggacgtacgggtcttacggtttaatacgtttacggttgggtagggggtaaggaacggggtaggaaccggggttaaaggtttaacggggtaaaccgggtttaggggggttacggggttcgggggacccggtaacgggggg

SEQ ID NO: 267006 - DNA, 638 bp, Homo sapiens
  misc_feature: GYAE6OF01CKRUT.28.57.F02.1.454.CMB.1.raw
  modified_base (309)..(309): a, c, t, g, unknown or other
  misc_feature (309)..(309): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctgggtggagtcgtggggggaggcttggtccaggccgtggggggtccctgagactctcctgtgcagcctctggacttcaccttcagttatttatgctatcgacacgtcgggtcccnccgaggcctccggaggggaacgggactaggaatgtgtctacgtaggtattaagaagtaatcgacgaaataacataataattatcgaactaaacgtcgtaggtaggaaacgggctagtattaccaccatcctaccggaaggaactaacgtaccaaagaaccacgtacttagttacttcctaacgaaacgtcgggacacgtaccgtaggaacgacgtacgtaggaacggaccgacggtcttagtaacttagttacggtgggtagggaggtaagggaacggtaggtaagttacgggtaaagggttagggttagggcggggccgtaacggggg

SEQ ID NO: 267007 - DNA, 609 bp, Homo sapiens
  misc_feature: GYAE6OF01B74IU.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccgtggggggtccctgagactctcctgtgcagcctctggattcaccttcagtatttatgctatgcacgtcggtccgccgaggccgtccgagggaacgggacgtaggaatagtgtctcgtaggtattagaagtaatgacgaataaccccatatattatagtacaaactactgtagaagggacgagtacttacacctactaccgtaccgacggtaactaacgttaaccaaacgaacaacgtacgtacgtacttacttactaagtacgggacgacgaccgtagagtacgcgtagacggacgacggtcgtagtattagttacgtggtagggaggaggaggacggtaagttagggtaacggttagggttgggtgggtcggtacgggg

SEQ ID NO: 267008 - DNA, 526 bp, Homo sapiens
  misc_feature: GYAE6OF01DTDS8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaataacatatatatgacaaactctgtagaagggcagattcaccatctcagggacaattaccaagaacacgctgtatcttacaatgggcagcctgagagctgagacacggctgatattacgtgtagggaggtaggagtggaagttggaacgttggggttggtggggccgaagggg

SEQ ID NO: 267009 - DNA, 725 bp, Homo sapiens
  misc_feature: GYAE6OF01EPADR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttattttaaaggtgtccagtgtgaggtgcagctgggtggagtcggtgggggaggtcgttgggtccaggtcccggttcggggggtccctgagtacctctccgtgtgcagtccctcgtggtacttcctaccttctagttattttagtgtactagtcgcgtacgtcggggtccccgccgacggcctaccggaaggggaacggtactaggaacttagttcgtactacgtagttagttaagaagtatacggaacgtaaataacgtaattacttaattaatacgaactaaacttcgtaggtaggaaggtccaagtactacctaaccagtacctaccggtaggaacctaacgtaaccaacgaaccgtcgtaccttgttaactcttaacgtaaacggtcggaacacgtaccggtagtacgacggtaccgttaggacgggtaaccgtaggtaccgttagttaaacgttacggttcggtaggggttaggggaagtacggggaacgggtaacggttaaggttaacgggaacggtttagggggtacgggtacgggggtacccggtaaccggggg

SEQ ID NO: 267010 - DNA, 605 bp, Homo sapiens
  misc_feature: GYAE6OF01BVGOM.28.57.F02.1.454.CMB.1.raw
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggtcgttggtccagccgtggggggtccctgagactctcctgtgcagcctcgtggattccaccttcagttatttatgctatgcacgtgggtccgccaggctccgagggaacgggactaggaatatgtctcgtaggtattagaagtaatgacgaaataaacattaataattatagactaaactntagtagaaggnagtattcaaccatccacgaggaactaactaccaaagacacgctagtatctaacaagtcgggacacgctagagacgtcgtaggacggaccgtacggcttagtaagttattacggtgggttaggggaaggtaagggacgggacggttaaaggttacgggaaacggtttagggggttacgggcgggggacccggtaaggggg

SEQ ID NO: 267011 - DNA, 858 bp, Homo sapiens
  misc_feature: GYAE6OF01AXHSJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggaggtcgtgggggaggcttggtccaggccgtggggggtccctgacgactctccgtgtcgcgagtcctcgtggacttccacctttctagttattttatgtctagtcgcctacgtcggggttcccgccgacgggtcccttacccggaagggggaaacggggtaccgttagggaaagtttacgttcggttccgttaaccgtaagggtttaagtttaaagggtaaaaggttaaaggttacggtaaccggtaaaaatttaaacccgtaaattaaatttaaagtttaaagtaccggtaacctaaaaaacccgtttgtttaacggtaaggggtaaaacggggtaccgtaaagggttaacctttaacccgaaccgttaacccgtttaccggtaaaccccggaacgggggttaaaacccttaaacgtttaaccccggaaaaagtaaacccgaccgtacttacggttaacttaccgttaaaccgtaaagttaccggggactacggaccgttaggaacggactccggttaaggaaccggaccggaccggtacgttaggttaacttacgttacggttgggtaggggaaggtaacgggaacggtacgggttaaaggttaggggtaaacggtttagggggttacgggtacgggggtaccggtaaaccggggg

SEQ ID NO: 267012 - DNA, 541 bp, Homo sapiens
  misc_feature: GYAE6OF01BTUTV.28.57.F02.1.454.CMB.1.raw
  modified_base (280)..(280): a, c, t, g, unknown or other
  misc_feature (280)..(280): n is a, c, g, or t
  modified_base (323)..(323): a, c, t, g, unknown or other
  misc_feature (323)..(323): n is a, c, g, or t
  modified_base (466)..(466): a, c, t, g, unknown or other
  misc_feature (466)..(466): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccgcaggctccgaggaagggctggaatangtctcaggtattagaagtatgacgaataacatatattatgacaaactctgtagaagggcagattcacatctacagggacaacttccaaagaccacgctagtatctacaagtgggacagcctagagtagcttgaggacacggtntgtaatagtttacgtggtagggaggagggaggacggtaagttcggaacgttaggggttgtgggggccgtaagggg

SEQ ID NO: 267013 - DNA, 564 bp, Homo sapiens
  misc_feature: GYAE6OF01CTJKA.28.57.F02.1.454.CMB.1.raw
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
  modified_base (547)..(547): a, c, t, g, unknown or other
  misc_feature (547)..(547): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccacctttcagttatttatgctatcgcacgtgggtcccgccaggcctccgaggggacggactggaatatgtctcaggtattagaatatgacgaataacatatattangactaactntggtgaaggcagattcacatctacgaggacaacttaccaagaacacgctagtacttacttacgaatgggcacgcctaggagagctggaacggcgacggtctagtatattacgtgggtagggaggagggaggacggtaagttcgggtaacggtaggggtttcgggnggggtcccggtaagggg

SEQ ID NO: 267014 - DNA, 733 bp, Homo sapiens
  misc_feature: GYAE6OF01CN8O1.28.57.F02.1.454.CMB.1.raw
  modified_base (286)..(286): a, c, t, g, unknown or other
  misc_feature (286)..(286): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (460)..(460): a, c, t, g, unknown or other
  misc_feature (460)..(460): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtaggtttgggctgagtcgttgggttttccttgttcgtacttaagtttttaaaggtcgtcctagtgtggaggtgcagtcgtgggtggagtcggtgggggagtcgttcgggtccaggccgggttcggggggtccctggaacgtctctccgtgtgacncgtcctgtggtacttccaacctttnaagtttatttacngtcttagtcgctacggttcgggacccnccgacggtcctaccgggaaaggggaaccggtacgtaggtaaactgtcggtcctacgtagggttaattaagaagttacgtagaacgtaaaattaacaattaataattagntaactaacgtgtaggtaagaacggntaacgtacttaccaactacgttacctaaccggaacggtaactaacgttaaccgaaacgaacgtaccgtacgttagttaacttaccggtttaaagaaacggtttacgggaccgttaaccgtaccgtaggtaacccggagttaccgaagggaaccgacgtaccggtagtacgtattagtacggtggtagggaacgtagggacggtaacgtaggttacggacggtttagggacggtcggggaagtacgggg

SEQ ID NO: 267015 - DNA, 661 bp, Homo sapiens
  misc_feature: GYAE6OF01EHE5F.28.57.F02.1.454.CMB.1.raw
  modified_base (580)..(580): a, c, t, g, unknown or other
  misc_feature (580)..(580): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggtcttggtccagccgtggggggtccctgagactctcctgtgcagcctctggattccaccttcagttatttatgctatcgctacgtcgggtcccgccgaggcctaccggaagggggaacggtacgtagggtaacttagttcgtcttacgtaaggttaagttaacggaaagttaagtacggaacgtaaataaacgtaattaattaattaagtacgaactaaaacttcgtaggtaggaagggtactaagtacttaccaacctattccgtaccgaacgggaactaacgttaccgaaagaaccacgtctacgttactaccgttaacaaaggtcgggacacgccgtaggagacgtcgtaggacgacgacgtntagtatagttacgtggtagggacggagggacggtacggtaagttacgggtaaggttaggggttggtcggggcgtaacgggg

SEQ ID NO: 267016 - DNA, 689 bp, Homo sapiens
  misc_feature: GYAE6OF01BM7CT.28.57.F02.1.454.CMB.1.raw
  modified_base (684)..(684): a, c, t, g, unknown or other
  misc_feature (684)..(684): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgacaaactctgtgaagggcagattcacatctccaggacaattccaagacacgctgtatcttacaaatgggcagcctgagagctgaggacacggctgtatattacgtggtgggagaggagacggtaattagggaacgttagggttggtcggggaccgagggacgcccgtggtccgaccggttcctccgtcgacgtccctacccaccgaacgggcccctagtcccggttcccttacccccgtgggacccgtcccctacggcccgttaccgacgggacctcccgacccgtccggaacgtaccggaccaccgtaacgggccccggtccccggtacggggtccctccgggtaccccggttacgggtaacccggtaaaccgggtaaccctttacccgttaccgaacgttacgggacccgttcgttaccgtagggtaccggaccggggttccgtacggggtacccgaaacggggtcccgtacggaacgttaacggcaagngacgg

SEQ ID NO: 267017 - DNA, 543 bp, Homo sapiens
  misc_feature: GYAE6OF01E1ZGZ.28.57.F02.1.454.CMB.1.raw
  modified_base (281)..(281): a, c, t, g, unknown or other
  misc_feature (281)..(281): n is a, c, g, or t
  modified_base (413)..(413): a, c, t, g, unknown or other
  misc_feature (413)..(413): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcacctttcagtatttangctatgcactgggtccgccaggctccgagggaggactggaatatgtctcaggtatagaagtatgcgaataacatatattatgcaaactctgtagaagggcagatcaccatctcaggacatcaagacacgctntatcttcaatgggacagcctagagacgctgacggacacggtctagttatagttacgtggtaggggacgagggaggacgggtaaagttacgggaacgttaagggggttcgggtcgggggccgtaacggggg

SEQ ID NO: 267018 - DNA, 664 bp, Homo sapiens
  misc_feature: GYAE6OF01EIW92.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactcgggtccgccaggctccgaaggggagggactggaatagtgtctcgaggttatagaagtatgacgaataacataatattatgactaaactcgtagtagaaggcagtacttaccaccgtactccgtacccgaagggtaactaacttaccgaaacgaaccgaccgtacttacggttaacttcctttaacgtaaaggtcgggacaacggtccctagggacgtacggtccgtagggaacggaccgtaccgggtactaggttaacttagtttacggtagggtagggggaaggtaaggggaacgggtacgggttaaagggtttacgggaaacgggtttaggggggtttaggggtccggggggtaaccgggtaacggggg

SEQ ID NO: 267019 - DNA, 567 bp, Homo sapiens
  misc_feature: GYAE6OF01DS7HT.28.57.F02.1.454.CMB.1.raw
  modified_base (387)..(387): a, c, t, g, unknown or other
  misc_feature (387)..(387): n is a, c, g, or t
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggggaggcttgggtccagcccgtggggggtccctgagactctcctgtgcagcctctggattcaccttcagttatttatgctatgctacgtcgggtcccgcaggcctccgaggggacggactggaattacgtgtctacgaggttaattagaaagtagtgacgaaataacattatattangacaaactctagtaggaaggcagtacttaccgaccatcctaccgaaggtacaattacccaagaccncgtctgtatctacaagtgggcaagcctgangctagacgancggtctatattacgttcgnggtgggagtaggagacggtaagttgggaaacggtttggtgggcggggacacgggg

SEQ ID NO: 267020 - DNA, 636 bp, Homo sapiens
  misc_feature: GYAE6OF01DOF2A.28.57.F02.1.454.CMB.1.raw
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagccgtggggggtccctgagactctcctgtgcagcctctggattcaccttcagtatttatgctatgcacgtgggtccgccaggctccgagggaggactggaatatgtctcgaggtattaagaagtaatgacgaaataacataataacttangactaaactcgtaggtaggaaggacagtattaccaactactctacccgaagggtacaaacttaccgaaagtaacacggtactagttacttaccttaacgaaagtcgggactaacggccttaggaacgtagtacgtacgggaacggtacgacggtaccgttagtacgttaagttaccgttagggtaggggtaaggagggtaacggacgggtaaaggttagggtaaaccgttagggggttcggtacggggtccggtaaacggggg

SEQ ID NO: 267021 - DNA, 589 bp, Homo sapiens
  misc_feature: GYAE6OF01D7USW.28.57.F02.1.454.CMB.1.raw
  modified_base (583)..(584): a, c, t, g, unknown or other
  misc_feature (583)..(584): n is a, c, g, or t
  modified_base (588)..(588): a, c, t, g, unknown or other
  misc_feature (588)..(588): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccaggacaattccaagaacacgctgtatcttcaaatgggcagcctgagagctgaggacacggctgtatattacgtggtgggagaggagcggaattgggaacgtaggggttgtggggccagggacgcccgtggtccaccgtctcctcacgccctccaccgaacgggccccagtccggtcccttcccccgtcggccgcccctgccctccgacggacgcccacccgtccgagacgcacgcggccggcccgtgggcctcggcccgtcgggtacgaacggtaccttaaccgttccaacgttacggtccgttaccgtccgtaggaccgggtccgggacgtcgggaccgaacgggccgtacacgtagnngcgng

SEQ ID NO: 267022 - DNA, 672 bp, Homo sapiens
  misc_feature: GYAE6OF01CINKB.28.57.F02.1.454.CMB.1.raw
  modified_base (287)..(287): a, c, t, g, unknown or other
  misc_feature (287)..(287): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctgggtggagtcgtgggggagcgttggtccaggccgtggggggtcctgagactctcctgtgcagctcgtggattcaccttcagttattatgctangctacgtcgggtcccgccgaggtcctccggaaggggaaacgggacgtagggaacttagtgttctcgtaggtattagaagtaatgacgaaataacatatattanagacaactntgtagaaggnagtattcgaacctatcgtaccgaggaactaacgttaaccaaacgtaacaacgtcttagtacgttaccttacgaaagttcggacgaacgtccgttaggaagtacggccgtaaggaacggtaccgacgggttactagggttaagttttaaacgttcgggttacgggttagggggaaaggtaacggggtaacgggtaacggggttaatttaacgggggaaaacggtttgggggtttaggggaccgggggtcgggtaaaaccggggg

SEQ ID NO: 267023 - DNA, 563 bp, Homo sapiens
  misc_feature: GYAE6OF01DM1CZ.28.57.F02.1.454.CMB.1.raw
  modified_base (559)..(560): a, c, t, g, unknown or other
  misc_feature (559)..(560): n is a, c, g, or t
  modified_base (562)..(562): a, c, t, g, unknown or other
  misc_feature (562)..(562): n is a, c, g, or t
tcagagtacgctatcacgaccggtgctcgatttagctcgatatagttgggtttgggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccaggacaatccaagaacacgctgtatcttacaaatgggcagcctgagagctgaggacacggctgtatattacgtggtgggaggaggagacggaagttgggaacgtagggttggtggggccgagggacgtcccgtggtccaccgtctcctcgacgcctaccaccgacggcccacgtccggtcccttcccccgtcggcccgcccgtcgccctccgaggcgccacccgtccgagacgccacgcggccggcccgtgggcctcgccgtgggtaccaacggcctacgtccacgtacggtcctactcgtggacggtcggcggtggcgaacggcgacagtagnngnc

SEQ ID NO: 267024 - DNA, 542 bp, Homo sapiens
  misc_feature: GYAE6OF01BX3TB.28.57.F02.1.454.CMB.1.raw
  modified_base (296)..(296): a, c, t, g, unknown or other
  misc_feature (296)..(296): n is a, c, g, or t
  modified_base (458)..(458): a, c, t, g, unknown or other
  misc_feature (458)..(458): n is a, c, g, or t
  modified_base (482)..(482): a, c, t, g, unknown or other
  misc_feature (482)..(482): n is a, c, g, or t
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattatgctatgcactgggtccncaggctccgagggaaggactggaatatgtctcaggtattagaagtaatgacgaataaacatatattatgacaaactctgtagaagggcagtatcaccatctccaagggactaattaccaaagaacaacgctagtactctacaatgggacagcctgagagtcngaggacacggctagtatattacgnggtagggngtagggagacgggtaagttacgggaagttagggttgtgggggccgtaagggg

SEQ ID NO: 267025 - DNA, 620 bp, Homo sapiens
  misc_feature: GYAE6OF01CZDXM.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctattttaaaggtgtccagtgtgaggtgcagctggtggagtcgtgggggagcttggtccagccgtggggggtccctgagactctcctggtgcagcctctggattcaccttcagtatttatgctatgcacgtgggtcccnccaggctccgaggggaacggactggaatatgtctcgaggtattagaagtataggacgtaaataacgatatattatgacaaactcgtgtagaaggctaagctacacatcctacgaggtacaacgttccaaagaccacgtactacgtactacttacaaagttcgggacagacccgtaggaacggtacgtacgtaggaacggaccggacggtacgttagttaacgtaacgttaccggtgggtaggggaacggtagggaacgggtacgggtaaaggttacgggaaacggttagggggtttacgggtcgggggaccgtaaccggggg

SEQ ID NO: 267026 - DNA, 625 bp, Homo sapiens
  misc_feature: GYAE6OF01DKLL5.28.57.F02.1.454.CMB.1.raw
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggagcttggtccagccgtggggggtccctggagactctcctgtgcagcctctggattccaccttcagttatttatgctatgctacgtcgggtccnccgaggcctaccggaggggaacgggacgtggaaacttntcggtctacgaggtaattaagaagtaatgaacgtaaataaacattaattaattatagaactaaacttctaggtaggaagggcaagtacttaccaccactcgtaaccgaaggtaactaacttacccaaacgaaccacggtcttagtacttacttacgaagtcgggacagcctaggacgtagctaggacggaccacggtacttagtacttagtacggtgggtaagggagtagggagtacggaagttcgggaaacgttgggggtacgggtggggccgtaagggg

SEQ ID NO: 267027 - DNA, 901 bp, Homo sapiens
  misc_feature: GYAE6OF01CU9PG.28.57.F02.1.454.CMB.1.raw
  modified_base (333)..(333): a, c, t, g, unknown or other
  misc_feature (333)..(333): n is a, c, g, or t
tcagagtacgctatcacgaccggtgctcgatttagctcgatatagttgggtctgggagaggacgccccccgccctgggtttcccaggtgttctcatttggtgatcagcactgcacacagaagagtcatgacggtagtttgggctgagtcgttgggttttccttgttgtcttaagtttttaaaggtgtccagtgtgaggtgcagcgtggtggagtcggtgggggaggtcgttggtccaggccggtcggggggtccctggacgctcctcctgtcgcacgtcctcgtggtacttcctaccttctagttattatgtctatcgctacgtcgggtcccncgacggcctaccggaggggaacggacgtaggtaatagttcgtactacgtaggttaattaaggtaaggttaaatcggaacgtaaaagtaaactaagttaattaactttagtacgaactaaactcggttagtaagggtaacggtacgtaacgtacttaacccgaacctacgttacccgaccgggtaaacggtaaaccttaaaccgttaaacccgaaacgtaaacccgtaccgttacgttaacggtttaactttacccttaaacggtaaacgggttacccgggtactaaacccgggttcccgttaaagggaacggtaaaccgggtacgggttaaacgggtaacccgggtaaccgggtaaaccccgggttggtttaaaccggttaaaacgttttaaacggtttaacccggggttaaggggggttaaacggggggtaaacgggtaaaacgggggtaaacgggtaaacccggggttttaaaaggggttaaaccgggggtttaaaaccgggggtttaggggggggttttaaccccgggggaccgggggggtaaaccccggggtaaaccggggggg

SEQ ID NO: 267028 - DNA, 596 bp, Homo sapiens
  misc_feature: GYAE6OF01C1DVB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagccggtggagtcgtgggggaggcttggtccagccgtggggggtccctgagactctcctgtgcagcctctggattcaccttcagttatttatgctatgcacgtcgggtccgccaggcctccgaggggaacgggactagggaatagtgtctcaggttattaagaagtaatgacgaaataacataagtatttatcgacaaactctgtagaagggcagtattacactactcctaccgaagggactaacttaccaaacgacacgacttgtactacttacaaagtcggcacgcctagagacgtcgtaggacggacgacggtcttaggtattagttacgtgggtagggagaaggacggaggtaaagttagggtaacggtaggggttgggacggggccgtaggggacccgg

SEQ ID NO: 267029 - DNA, 668 bp, Homo sapiens
  misc_feature: GYAE6OF01A9S7F.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtgggggaggcttggtccagccgtggggggtccctggagactctcctgtgcagcctctggattcaccttcagtatttatgctatgcacgttcgggtcccgccaggcctccggaggggaacgggctggaatagtgtctcgaggtattaagaagtaatgacgaaataacatatattatagactaaactcgtagtaggaagggacaagtacttcgaaccctattccgtaccgaagggaacctaacttacccgaaagaaccacgtctagtacttacttacaaagtcgggacacggccgtagaacggtaggaccgtagggaacggtaccgaacgggtcgttacggttaagttaacgtttaacggtgggttaagggggtaagggaaaggggtaacggtacggggttaaaaggtttacggggtaaacggtttagggggttcggggttaccggggggccggtaaacggggggg

SEQ ID NO: 267030 - DNA, 718 bp, Homo sapiens
  misc_feature: GYAE6OF01EFCD2.28.57.F02.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggagcgttggtccagccgtggggggtccctgagactctcctgtgcagcctctggattcaccttcagtatttangctatgcacgtcgggtcccnccgaggcctaccgagggggaacgggactgggaatagtgtctacgaggttaattagaagtaatgacgaaataacattatattatgactaaactcgtaggtaggaacgggtcaaggtaattacccaacccgtaattcccgtaacccggaaagggtaacctaaacgtttaccaaaacggtaaccaccgtacttacgtattaccgttacaaacggttgggactaacggtccttaggacggtacgtacgttagggaacggtaccggtaacgggtcgttaaggtttaacgttaacgttttaaccgggtagggttacggggggaaacggtagggggtaaccggtacgggttaaaacggttttcgggggaaaaacggtttttggggggggtacggtaccgggggggacccgtaaaccggggggg

SEQ ID NO: 267031 - DNA, 767 bp, Homo sapiens
  misc_feature: GYAE6OF01BHRSG.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagcgttggtccaggccgtgggggtccctgacgactctcctgtgcacgcctctggtattcctaccttctaagttatttatgtactatcgcctacgtcgggtcccgccgacggtcctaccgggaaggggaacgggtacgtaggtaacttagtcgtactacgtaaggttaagtttaaggaaagttaagtaggaacgtaaataaactaattaattattaatagaacctaaacgtcgttaggtaggaaacgggactaagtacttaccgaaccctacttaccgtacccggaaaggtaaacctaaacgttaaccgaaaacgtaaccctaaccgtacgttacgttacttaccgttaacgtaaacggtccgggtaactacgtaccgttaggaacggtacggtaccgtaagggaaccggtaccgtaccgggtactttaacggttaacgttaacgttacggtaggggtaacggggaagggtaaggggtacgggtaacggttaaaggttaacggggtaacgggtttaggggttacggggtacgggggtaaccggtaaccggggg

SEQ ID NO: 267032 - DNA, 662 bp, Homo sapiens
  misc_feature: GYAE6OF01DW66M.28.57.F02.1.454.CMB.1.raw
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtgggggagtcttggtccaggccgtggggggtccctgagactctcctgtgcacgcctctggtacttcaccttnagttatttatgtactatgctacgtcggggtcccnccgtaggccttaccggaggggaacggacttagggaatagttgtctacgtaaggttatttaaggaaataatagacgtaaaatacaattaattataatgaactaaactcgtagtaggaaaggtctaacgtattaccactacgtacctacgaagggacctaacgttacaaacgaacctacgcttagtacttactaccaagtcgcaacgtcctagaacgtgacgtacggaagaccgtacgggtacttaagtacgttaacgttacggaggttaggggtaggaagggtaacggtacgggttaaaggtttacggggaagttaggggggttacgggttacggggccggtaaccggggg

SEQ ID NO: 267033 - DNA, 599 bp, Homo sapiens
  misc_feature: GYAE6OF01DDXI8.28.57.F02.1.454.CMB.1.raw
  modified_base (580)..(580): a, c, t, g, unknown or other
  misc_feature (580)..(580): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattcaccttcagttatttatgctatgcacgtgggtccgccgaggctccgaggggaacggacgtgggaatatgtctacaggtattagaagtaatgacgaataacattatattatgacaaactctggtagaagggcagtacttccaccatcctaccgagggaacaacttaccgaaagaaccacgtcttagtacttacttacaaagtcgggacacgccgtaggagtagcgtaggacggactacgggcttacgtagttagttacgtagggtgggaagagggaggacggtaagttacgggaaacggttgggggttacgggngggggtccggtaacggggg

SEQ ID NO: 267034 - DNA, 666 bp, Homo sapiens
  misc_feature: GYAE6OF01BAYNY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtggggggtccctgagactctcctgtgcagcctctggattccaccttcagtattttatgtctatgcacgtgggtcccgccgaggcctccggaggggaacgggactgggaatagtgtctcgaggttatagaagtatgacgaataacattaatattatgactaaacttcgtaggtaggaagggtcaaggtacttccaaccctattcccgtacccggtaaggggaaccctaaactttacccgaaaaggaacccgtaccggtacgttaccgttaattccctttaacgaaaggttcggggacctaacggcccgttaaggacggtaacggtcgtagggaaccggacgtaccggtctaggttattacgttaccggtgggtagggaggtaagggaggtacgggtaaagttcggggaacgttaggggttcgggtacggggccgtaaggggg

SEQ ID NO: 267035 - DNA, 852 bp, Homo sapiens
  misc_feature: GYAE6OF01BCBOW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccaggccgtggggggtccctggagactctccgtgtcgcgagtcctcgtggtattcctaccttcgtaagttatttatgtctatgctacgtcgggtccgccgaggcctccggaggggaacggtacgtggtaatagtgtctacgtaggtaagttaagaagtaagtagacgtaaagtaaactaataattaatttagtacgtaacctaaaacttcgttaggttaaacggaaacgggtactaaacggtaacctttaccaaaccctaacgtttaccccgtaacccgggtaaacgggtaaaaccttaaaccgttaaaccccgaaaacggtaaacccgtaaaccgttaccgttaacggttttacctttaacccgtttaacggaaaaacgggtttcccgggggaacttaacccggtacccggtaagggaacgggtaacggtacggttaaccgggaacggggtaacccgaaccggggttaacgttaacggtttaaacgttaaccggtttaacgggttacggggttaacgggggaagggtaaacggggtaacgggttaaacgggggtttaaacgttaagggggttaaacccggttaggggggttttaccggggtaacgggggggtacccgggtaaacggggggg

SEQ ID NO: 267036 - DNA, 840 bp, Homo sapiens
  misc_feature: GYAE6OF01ERZHH.28.57.F02.1.454.CMB.1.raw
  modified_base (707)..(707): a, c, t, g, unknown or other
  misc_feature (707)..(707): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtgctattttaagtgtcagtgtgaggtgcagctggtggagtcgtgggggaggcttggtccagccgtggggggtccctgagctctcctgtgcagcctctggtacttccaccttcagttatttatgtctatgctacgtcgggtcccgccgaggccgtaccgagggggaaacgggtacgtagggtaaatagtcgttcctacggtaagggttaagttaaggtaaaacggttaagttacggaaccggtaaaatttaaaaccgtaaatttaaactttaattttaaacgttacggtaaacccttaaaaaccgtttccgtttaagggttaaggggaaacggggtaccgtaaagggttactttaccccgaaacccgtacttaccccggttaacccgggtaaaggggtaaaccctaaacgtttaccccgaaaacgtaaacccgtaaccggtaccttacggtttaacctttacccgttaaacggtaaacggttccggggactaaaccgggcccgttaaggaacgtaacggtcgttaacgggaacgggtaaccgtacccggggtntttaagggttaacttaagtttaccggtggggttaggggaaagggtacggggaacggagggtttaaaacggttacggggtaaacgggtttacgggggtttaggggtaccggggggtaaccggtaaccggggggg

SEQ ID NO: 267037 - DNA, 569 bp, Homo sapiens
  misc_feature: GYAE6OF01ER811.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgcaggctccgngggaagggctggaatatgtctcaggtattagaagtaatgacgaataacatatattactgactaaactctgtgaagggcagattcacatctcaggaacatcaagaacacgtctgtactcttacaaatgggacagccctggaacgtagcgttagaggaccgacggcgtagtattacttacgttggtaggggtaaggacgggaggacgggtaagttaggggtaaacttaggggggtttaggttcgggggtccgggtaacgggggg

SEQ ID NO: 267038 - DNA, 523 bp, Homo sapiens
  misc_feature: GYAE6OF01BXYWK.28.57.F02.1.454.CMB.1.raw
  modified_base (297)..(297): a, c, t, g, unknown or other
  misc_feature (297)..(297): n is a, c, g, or t
  modified_base (377)..(377): a, c, t, g, unknown or other
  misc_feature (377)..(377): n is a, c, g, or t
  modified_base (435)..(435): a, c, t, g, unknown or other
  misc_feature (435)..(435): n is a, c, g, or t
  modified_base (474)..(474): a, c, t, g, unknown or other
  misc_feature (474)..(474): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagtatttatgctatgcactggtccncaggctccagggaaggctggaatatgtctcaggtattagaagtatgcgaataacatatattatgcaaactctgtgaaggnagattcaccatctccaggacatacaagacacgctgtatctacaagtggcagcctgagngctgacggacacggctaggtatacttacgtggtggaggnggaggcggtaagttgggaacgttaggggttggtgggggcgtaacggggg

SEQ ID NO: 267039 - DNA, 572 bp, Homo sapiens
  misc_feature: GYAE6OF01AXIUB.28.57.F02.1.454.CMB.1.raw
  modified_base (369)..(369): a, c, t, g, unknown or other
  misc_feature (369)..(369): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcacgtgggtccgccaggctccgagggaagggactggaatatgtctcaggtattaagaagtaatgacgaaataacataatattangacaaactctaggtagaagggcagacttcacatctcgaggacaataccaagacacgctgtatcttacaagtcgggacagcctaggagacgcgtagaggacncggtacttaggtatacgttacgtgggttaggggacggaagggaggtacggtaaaggtttacgggaacgtttaggggttacgggtgggggtcccgaacggggg

SEQ ID NO: 267040 - DNA, 606 bp, Homo sapiens
  misc_feature: GYAE6OF01EDTNZ.28.57.F02.1.454.CMB.1.raw
  modified_base (564)..(564): a, c, t, g, unknown or other
  misc_feature (564)..(564): n is a, c, g, or t
  modified_base (594)..(594): a, c, t, g, unknown or other
  misc_feature (594)..(594): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtgggggtccctgagactctcctgtgcagtcctgtggattccaccttcagttatttatgcttatgctacgtcggggtcccgccgacgggcctaccggaagggggaacggggactaggaatattgtctcgaggttaattagaagttaagtgacgaaataacattatattatgactaaactcgtagtaggaagggcaagtacttaccaccattcctacgaacgggaacaacttaccaaagaaccgacgtactagttactacgttaacaaagtcgggacaacgcctagagtagcgtagacggacacggtctaggttacttagttacgtggtagggaggnggaggcgtaagtcggtaacgtgggtttggngggcgtacgggg

SEQ ID NO: 267041 - DNA, 941 bp, Homo sapiens
  misc_feature: GYAE6OF01D5PDT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgttgggtttttccttgttgtcttaagtttttaaaggtcgtcctagtgtgaggtgcagcgtgggtggagtcggtgggggagtcgttggtccgaggtccggtgggggggtcccctaggacgtaccttccgtccgtggtcgaccgacggtcccgttcgtacggtatttcccgtaaccctttccgtaaggtttaattttatcggtccttaagtcgccgtaccgtcggggttcccgacccgtagggtcccttacccgggaaagggggaaacgggtaccgtaaggggtaaattaacgttggtacccttacggtaagggtttaaatttaagggaaaagttaacgtacggtaaacgtaaaaacttaaactaagtttaaattaagttttaaacgacggttaaaaccctaaaaccgtttccggttaaggtaacgggtaaaacggggtactaacggttaacgttaacccctaacccgtaatttaacccccgtaccgggaaacgggtaaacccttaaaccgtttaacccggaaaacggtaaccgtacccgtaacgtttacggttaaaccttaccgttaaacgtaaacggttcggggaaccctacgggttaccgtaacgggagtaaccgggtttccgaaggggaaacgtacccgggtacggtttaacgtacgtttaaacgttaaacgtttccggggtaaggggttaacgggggaaaggacgggttaacggggtaacgggttaaacggtttaaacggggaacggggttttaggggggtcgggtaaccggggtccggggtaaaccggggg

SEQ ID NO: 267042 - DNA, 671 bp, Homo sapiens
  misc_feature: GYAE6OF01CW2MY.28.57.F02.1.454.CMB.1.raw
  modified_base (398)..(398): a, c, t, g, unknown or other
  misc_feature (398)..(398): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagctgggttttccttgttgctatttttaaaggtgtccagtgtgaggtgcagctggtggagtcgtgggggagcttggtccagccgtgggggtccctgagactctcctgtgcagcctcgtggactttccacctttcagttaattttatgactatcgacacgttcgggtcccgccaggcctccgaaggggaagggactagggaactgtcgtctacgtaggtattaaggaagtaatggaacgaaataacaattataattanagacaaacttactggtaggaagggcaagacttccgaactactacaccgaagggaacctaagttaacccaaaggtaaccacgtacttagtaacttccgttaacaaagttggactaacgccgtaggagacgtcgtacggaacgggaccgacggtacgttagttacgttaagttacgttggggtaagggtacggaaggggtacgggaacgggtttaaagtttacgggaaaaccgggtttagggggttcgggtaggggggacccggtaaacgggggg

SEQ ID NO: 267043 - DNA, 685 bp, Homo sapiens
  misc_feature: GYAE6OF01CP3O5.28.57.F02.1.454.CMB.1.raw
  modified_base (175)..(175): a, c, t, g, unknown or other
  misc_feature (175)..(175): n is a, c, g, or t
  modified_base (294)..(294): a, c, t, g, unknown or other
  misc_feature (294)..(294): n is a, c, g, or t
  modified_base (320)..(320): a, c, t, g, unknown or other
  misc_feature (320)..(320): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggngtccagtgtgaggtgcagctgggtggagtcgtgggggaggtcttggtccaggccgtggggggtccctggacgactcctcctgtgcgacgcctctggtacttccaccttcagttaatttntgtactatcgccacgtcggggtcccnccgacggtcctaccggaaggggaaggctggaatatgtcctagaggtattaagaagtatggactaaataacaattatactatagactaaaccttgtaggtaggaacggactagacttaccactcgtaccacggtaaggaactaactaaccgaaagtaaccacggtactacgtattaccgttacaaaaggttcgggacctcggtaaccgtggaacgacggtaccgttaagggaacgggtacccgtacgggtacctttaaaggtacttaacggttacggtacggggtagggaacgggtaagggacggtaacggttaaggttacggggtaaacggtttggggtacgggtaggggacccggtaacggggg

SEQ ID NO: 267044 - DNA, 626 bp, Homo sapiens
  misc_feature: GYAE6OF01B1SKM.28.57.F02.1.454.CMB.1.raw
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctctggattcaccttcagttatttatgctatgcacgtgggtcccgcaggcctccgagggaaggactaggaatatgtctcgaggtattagaagtaatgagaaataacatatattatgactaactntgtaggaaggcagtactcactatccacgaaggactaacttccgaaagaaccacgtactagttactcttaacgaaagtcgggactacgtctaggacgtacgctagggaacggaccgacgggtcttaggttaacttagtttaacggtcggggtaggggaacggtaaggggacggtaacgggttaaagggttacggggtaaacggtttaggggggttagggtacggggggtacccggtaacgggggg

SEQ ID NO: 267045 - DNA, 654 bp, Homo sapiens
  misc_feature: GYAE6OF01EJII6.28.57.F02.1.454.CMB.1.raw
tcagagtacgctatcacgaccggtgctcgatttagctcgatatagttgggtctgggagaggagcccccgccctgggtttcccaggtgttcttatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggacttcaccttcagttatttatgtctatgctacgtgggtccgccaggcctccggaaggggaagggacgtaggaatagtgtctcgaaggttattaaggaagttaatgacgaaataaacattaattatttaatcgactaaacttcgtgtaggaaagggctagtacttaccgaacctataccgtacgaacggtacaaacgttaccaaagaaccacgtccttagtaacttcttacgaaagttcgggactaggtaccgtaggaggtagtacttagggaacggccgaacggtctaggttaattacgttacgtgggtaggggaaggagggacggtacgggtaaggttacgggtaaacggttagggggttaggttcgggggacgtagggggtaaccccgg

SEQ ID NO: 267046 - DNA, 803 bp, Homo sapiens
  misc_feature: GYAE6OF01BMVQM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagctgggttttccttgttgtcttatttttaaaggtgtccagtgtgaggtgcagctggtggaggtcgtgggggaggcgttggtccaggccgtggggggtccctggacgactctcctggtgcacgcctcgtggattccaccttcagttattttatcgtacttatcgctacgtcggggtcccgccgacggcctccgaggggaacgggtacggtaggaagttagtgttcctacgtaggttataaaggtaaagttaacgtggacgaaaattaacgaattattaattaagtagtactaaacgtcgtaggtaagggaaacggtcgtaagtactttaccgaacccttacgtacccgttaacccgaacgggtaaacctaaacgttaaccccgaaaagtaaacccgtaaccgtacgttaacggtttaacttaccctttaaacgtaaaagtaccggggtaccctaacggtcccgttaagggaacggtaacgggtaccgtaacggggtaaccggaacgtaaccgggtaccgtttaaagttacggttaaacgtttacggtacggggttaggggaaagggtaacggggaacgggttaacggggtaaggtttaccggggtaagggttttaaccgggggttcggggttaacggggggcccggtaaaaccggggggg

SEQ ID NO: 267047 - DNA, 741 bp, Homo sapiens
  misc_feature: GYAE6OF01EDEW0.28.57.F02.1.454.CMB.1.raw
  modified_base (258)..(258): a, c, t, g, unknown or other
  misc_feature (258)..(258): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagccgtggggggtccctgagactctcctgtgcagcctntggtattccaccttcagtatttatgactatcgctacgtcgggtcccgccacgggccttaccggaaggggaacgggactaggaattagtgtacctagaaggttattaaggaacgtaagtcggaacgtaaataaactaattaattaatttaagtacgtaactaaaaccttcgttaggtaaggaaacggggtactaagtactttaccaacctacgttccctacccggaaggaaccttaaacttaccaaacggtaaccacggtcttaagttacttaccgttaacaaacggttcggggactaacggtcccgtaagacggtagaccgttaggaacggtaccgaccggtgttaaggttaaacttacgtttaacggggtgggttaaaggggacgggttaaacgggtaacgggtaccggggttaaaagggtttacggggtaaaacgggtttaggggggttttacggggacggggggcccggtaaacgggggg

SEQ ID NO: 267048 - DNA, 724 bp, Homo sapiens
  misc_feature: GYAE6OF01D2BNZ.28.57.F02.1.454.CMB.1.raw
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctgattcaccttcagttatttatgctatgcacgtggtccgcaggcctccgagggaggactaggaatatgtctgtagtataagaagtaatgacgaaataactatataattanagactaaactcgtaggtaggaagggcagtacttaccaacctatccgttaccgaaagggtaactaaacttacccaaacggaacctaaccggtactagttaacttaccttaacgtaaacgtcgggacctaacggcccgttaggaacggtacgtccggttaagggaaccgggtaccgtaaccggtccgttaaggttaaactttaaacggtttaaccggttgggggttaaggggaaaggggtaaacgggtaaacggggtaaccggggttaaaaggttttaacgggggggtaaaaccgggttttaaggggggggtttaaccgggggttagggggggtaaccccggtaaacgggggggg

SEQ ID NO: 267049 - DNA, 603 bp, Homo sapiens
  misc_feature: GYAE6OF01DKUW2.28.57.F02.1.454.CMB.1.raw
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagccgtggggggtccctgagactctcctgtgcagcctctgattcaccttcagtattatgctatgcacgtggtccgcaggctccgagggaggactggaatangtcanaggtatagaagtaatgacgaaataaacattaataattatgacaaactctaggtagaagggcaagattacacctatcacgaaggacaaacttaccaaagtaacacgtctagtactcttacaatcgggcaacgcctaggagagcgtaggaacggacgacggtacgtacgtattaacgttacggttaggtaggggaagtaggggaaacggtacgggtaaacggtttacgggtaaaacggtttagggggttacgggtcgggggtaccggaaacgggggg

SEQ ID NO: 267050 - DNA, 763 bp, Homo sapiens
  misc_feature: GYAE6OF01DWWFB.28.57.F02.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (438)..(438): a, c, t, g, unknown or other
  misc_feature (438)..(438): n is a, c, g, or t
tcagagtacgctatcacgaccggtgctcgatttagctcgatatagttggggtctcgggaaggacggagcccccggtcccttccgggtttcccgaggtccgttcctccaatttggtgactccaggcactgccgaccacgacgaagacgtcataggacggtagttttcgggcttgagcgttgggttttccttgttgcttagtttttaaggtgtccagtgtgaggtgcagctggtggagtcgtgggggagcttggtccagccgtggggggtccctgagactctcctgtgcagcctcgtggtattccaccttnagttatttatgtctatgacncgtcgggtccgccaggcctccgaggggaaggtactggaatgtgtcctnaggttatagaagtatgacaaataanatatattatgacaactctgtagaaggnatnttaccnccgtatccgtacgaaggtactaaacgttacccgaaagtaacctacgtccgttagttacctttacgtttaacgaaacggttcggggactaaacccggttccgtaagggaaccgcgttacccggggtaagaaccgggggtaaccctaaccggggttaaccgttttaagggttaaactttaacccgttttaacggggtttgggggaaaggggtaaaggtaaccgggggtaaaggtaccgggttaaaaggggttttacggggttaaaaacccgggttttggggggggttttacgggacccgggggggttaaccggtaaacccggggggg

SEQ ID NO: 267051 - DNA, 625 bp, Homo sapiens
  misc_feature: GYAE6OF01AN9MA.28.57.F02.1.454.CMB.1.raw
  modified_base (563)..(563): a, c, t, g, unknown or other
  misc_feature (563)..(563): n is a, c, g, or t
  modified_base (575)..(575): a, c, t, g, unknown or other
  misc_feature (575)..(575): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttaaaggtgtccagtgtgaggtgcagctggtggagtcgtgggggaggcttgggtccaggtccgtggggggtccctgagacctctccgtgtgcacgcctgtggacttcaccttcagttatttatgctatgctacgtcggtccgccgaggcctaccggagggaacggtactacggaatactgtctacgaggtattagaagtagtgacgaaataacgatagtattactgtaactaaactctaggtaggaacggtactaagactttacgacctaagttcctaccggaaggtaactaacgttaccgaaacgaaccgacgtactacgtacttactagtaacggtcgggactagaccgtaggacgtcgacgtagggacgtacgcgtattacggtattagttacgngggtaggaaggnggacggtagttaacggtaggtacggtaggggttcggtggggacgtcgggg

SEQ ID NO: 267052 - DNA, 640 bp, Homo sapiens
  misc_feature: GYAE6OF01AZYNI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctggagactctccgtgtgcagcctctggacttcaccttcagttatttatgctatgctacgtgggtcccgccgaggcctaccggagggaacgggactagggaactagtgtctacgtaggttaactaagtaaagttaataggacgtaaataaacgattaattattagtacgtaactaaacgtctaggtacggaaggtactaaggtacttacaaccgtataccgtaccgaagggtaacctaacgttaccgaaacgaacgacgtctagtacgttactacgtaagtcgggaccagtaccgtagacgtacgcgtaggacggacgtacggtcttagtacgtagttacgtggtgggaagagggtagaggtaacgtacggtaacggtagggttcggtacggggtcgtaacgggg

SEQ ID NO: 267053 - DNA, 713 bp, Homo sapiens
  misc_feature: GYAE6OF01CTH88.28.57.F02.1.454.CMB.1.raw
  modified_base (181)..(181): a, c, t, g, unknown or other
  misc_feature (181)..(181): n is a, c, g, or t
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagagtacgctatcacgaccggtgctcgatttagctcgatatagttgggtctgggagaggagcccccgccctgggtttcccaggtgttctcattggtgatcagcactgcacacagaagagtcatggacggtagttgggctgagcgtgggtttctgtgctattttaaggtgtcagtgtggngtgcagtcgtggnggagtcggtggggcgtgttcggaccgcggccgggtcgggggtccngaacgctctcgtgcgcgacgtccgtgtagtacttcctaccgttgtaagttaattgttnacttagcgtcgtacggtcggtccnccggcggtaccgaccggaagggtacgaggtaaggtaatntccgtgtagtagttaagtaaagtaatacgtaagaacgtaaactaataattagtaactatggaaactcgtattaaggagggaaacgagtacgacttaacaactactaccgtacgacggtaaactaaccttaaacgaaacgtaacccgtatacgtactattaactaacgttaaggtgaccgtacgacgtaggaccgtaggacgtacgaacgacgggtacgtagttaataccggtttaagtacgggtagggtagggaacgggtaagggttaccgggtaaagggttaaagggtttaaccgggggtaacggttaagggggtttacggggaaccgggggtaaccgggtaacccgggggg

SEQ ID NO: 267054 - DNA, 551 bp, Homo sapiens
  misc_feature: GYAE6OF01C16A2.28.57.F02.1.454.CMB.1.raw
  modified_base (413)..(413): a, c, t, g, unknown or other
  misc_feature (413)..(413): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagcctggggggtccctgagactctcctgtgcagcctctggattcaccttcagtatttatgctatgcacgtgggtccgccaggctccgagggaaggactggaatatgtctcaggtattagaagtaatgacaataacatatattatgacaaactctgtgaaagggcagatcaccatctacaggacaataccaanacacgcttagtacttacttacaaagtgggcagccgtagagagctagaggacacggtctagtactagttacgtggagggtagagggagtacggaaagtttcgggaaagttggggtttcggtagggggccgtaacggggg

SEQ ID NO: 267055 - DNA, 604 bp, Homo sapiens
  misc_feature: GYAE6OF01APOAH.28.57.F02.1.454.CMB.1.raw
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggaggcttggtccagccgtggggggtccctgagactctcctgtgcagcctctggattcaccttcagttatttatgctatgcacgtgggtcccnccgaggcctccgaggggaacgggcttgggaatagtcgtctacgaggttatagaagtaatgacgtaaataacattatattatgactaaactctagtagaaggcagtattccactatctaccgaaggacctaattaccaaagacacgtctagtatccttanaagtggacacgccgtagagacgcgtaggacggacacgggtctagttattacgttacgtgggtagggaaggagggtaagggtacggttaaaggttcgggtaaacgggtttaggggttacgggtacggggaccgggtaacggggg

SEQ ID NO: 267056 - DNA, 572 bp, Homo sapiens
  misc_feature: GYAE6OF01A9GD5.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcacctttcagtatttatgctatgcactgggtccgcaggctccgagggaaggctggaatatgtctnaggtattagaagtaatgacgaaataacatatattatgacaaactctgtaggaagggcaagattcaaccatcctaccgaagggactaacgttaccaaagaaccacgactgtactactttacaaagttgggacagacctgacgagctggaacggacacggcttagtataagttacgtggtagggtaggagggagacggtaaggttagggaacggttaaggggttcggttgggggcgtaacgggg

SEQ ID NO: 267057 - DNA, 775 bp, Homo sapiens
  misc_feature: GYAE6OF01CCX31.28.57.F02.1.454.CMB.1.raw
  modified_base (322)..(322): a, c, t, g, unknown or other
  misc_feature (322)..(322): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagtcttgggttttccttgttgcttaatttttaaaggtgtccagtgtgaggtgcagcgtggtggagtcgtgggggagcgttggtccaggccgtggggggtccctgagactctcctgtgcagccttcgtggtacttccacctttcaagttatttagtcgctatgctacgtcggggtcccncgacggtcctaccggaaggggaaacgggacctagggaaattagttcggtactacgtaaggttaattaaaggaagttaaatggaacgaaaattaaactaattaattaactttaagtacgaactaaacttcgtaggtaggaacgggactaagtactttaccgaacctacttaccgtaaccggaaacgggtaaacttaaacgttaacccgaaaacggtaaaccgtaaccgttacgttaacgtttaacttaaccgtttaaacgtaaaacgggttcgggaaccgtaacggtacccgttaaggaacgggtacgtacggttacggaacgggtaccgaacggtcttaaggttaaacgttagttacggtacgggttagggaacggtaacgggaacggtacgggtaaacggttacgggtaaacggtttgggggtacgggttacgggggaccggtaaacggggg

SEQ ID NO: 267058 - DNA, 849 bp, Homo sapiens
  misc_feature: GYAE6OF01DCAU5.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggtaggtttgggctgaggtcgttgggttttccttgttgtcttaagtttttaaaggtgtccagttgtggaggtgcgagtcgtgggtgggaggtcggtggggggaggtcgttcgggtcccgaggtcccggttcgggggggtcccctaggaacgtaccttcctccgtgttcgcgacgtccttcgtggtacttcctaacctttcgtaagtttatttaagtcgtcgtatcgaccgtcggtccgggtcccgaccggacggtccgtaaccgggaaggggaacggtaacgtagggtaaataggtcgtacgtaacggtaaaggttaagttaaaggaaagttaagtaacgtaaaccgtaaaattaaactaagtttaaatttaatttaacgacgtaaaccttaaaccgtcgggttaaggtaagggtaaacgggactaacgtacttaaccgacctaacgtacccgtaaccgtaaagggtaacctaaaccgttaacgaaaccgaacgtacccgttagtaaccgtttactaaccggttaagtaaacgggtcgggaacgtacgaccgtaaggacgtaacgtcggtaacggaacgggtaccgacggtgttaacgttaagttaacgttggtaacggggtaagggaaggtacggggtaaaggtaaccggggtttaaaggttacggggaaacggggttttgggggttaacggggccgggggttacgggtaaaccgggg

SEQ ID NO: 267059 - DNA, 656 bp, Homo sapiens
  misc_feature: GYAE6OF01B46GE.28.57.F02.1.454.CMB.1.raw
  modified_base (401)..(401): a, c, t, g, unknown or other
  misc_feature (401)..(401): n is a, c, g, or t
tcagagtacgctatcacgaccggtgctcgatttagctcgatatagttgggtcgtgggagaggagcccccgccctgggtttcccaggtgttctcagtttggtgatcgacgcactgcacacgagaacgagtcatgacggagtttgggctgagctagggttttccttgttgctattttaaaggtgtccacgtgtgaggttcgcagctggtggagtcgtgggggagcgttggtccagccgtgggggtccctgagtactcgtcctgtgcagtccttcgtggtattccaccttcagttattagtacgactaatcgactacgtcggtccgcgaggctaccgagggaacggactaggaatagtcggtctacgtaggtattagaagtactgacgtaatactatatattanagtacaaactctagtacgaagggtcaagtacttaccgacctatccgtaccgtaggtaacttaacgttaccgtaaacgtaacctacgttacttagttacgttaccttaacgaaagttcgggacacgtaccgtaggacgtacggacgtagaacgggacgtacggtactagtacgtaacgtttcgagggttacgggagagggaacgtacgggtaagttcgggaaggtttacgggttaggtccggggtccgtaacgggg

SEQ ID NO: 267060 - DNA, 710 bp, Homo sapiens
  misc_feature: GYAE6OF01DOFFP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtgggggtccctgagactctcctgtgcagcctcgtggattccacctttcagttatttatgctatgctacgtcgggtcccgccgaggcctccggaaggggaacgggtacgtagggtaaattagtgtctacgtaaggttaattaaggaaagttaagtgaacgtaaataacattaattattatgactaaacttcgtaggtaggaagggactagtacttaccgacctattaccgtaccgaagggtaactaacttacccgaaagaacctacgtcttagttacttacgtttaacgaaaggttcgggactacgtacctaggaacgtacgtacgtaaggaacggtaccgtaacgggtccttaggttaacttaacgtttacggtaggggttacggggaaggtacggggtaacgggtaacgggttaaagtttacgggggtaaacggttttaggggggtttcgggtaccggggggtacccgggtaaacggggg

SEQ ID NO: 267061 - DNA, 659 bp, Homo sapiens
  misc_feature: GYAE6OF01AHWYM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccgtggggggtccctggagacctctcctgtgcacgcctctggattccacctttcagttatttatgctatcgctacgtgggtcccgccagggcctaccgaggggaagggactggaatatgtctcgaaggttattaagaagtaattgacgaaataacatatattatgactaaatctgtagaagggcagtattcacctactcctaccgaggaactaacgtacccaaagaaccgacgcttagtacttaccttacgaaagttcgggacaacggtacctaggacgtagtaccgtgggaaccggacgaaccgggtcgttaaggttattaagtttaccggtgggttaggggaggtaaggggaacggtaacggggtaaacggtttaaggggtaaccgggtttaggggggttacgggttcggggggtaccggtaaccgggggg

SEQ ID NO: 267062 - DNA, 759 bp, Homo sapiens
  misc_feature: GYAE6OF01DMD5U.28.57.F02.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (280)..(281): a, c, t, g, unknown or other
  misc_feature (280)..(281): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggcgtatttaagtgtcagtgtgaggtgcagctggtggagtcgtggggngtcttggccngccgtgggggtcctgacgtctctcgtgtcgcacgtcctgtggacttcaccttgagttatttannctatgctacggtcggtccgccgtaggccgtaccggaaggggaccggtacgtagggtaaatgttcggtcctaggtaaggtttagtaaggtaagttaactaggaacctaaatataattattatatacaacgttaaactgttaaggaggaacggacgtatacttaccaacgttctaccgtaccgaaggtaacctaacgttaaccgaaacggaactaccggtacgtttacgtaacttaacccgtttaacgggtaagtccgggtaacgacccggttacgtaggtacggaaccgttcggtaagggtaacccggaaacggtccggtagtttaagttaaccgttaaggtttacgggttaacgggggtagaaagggggttaaccgggaagggttaaacccggggtttaagggtttaaaccccgggggttaaaggtttacgggggggttaaaccggggttcggggaaacccgggggttaacccggggg

SEQ ID NO: 267063 - DNA, 578 bp, Homo sapiens
  misc_feature: GYAE6OF01AK8FS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagtatttatgctatgcacgtgggtccgccaggctccgagggaaggctaggaatatgtctcaggtattagaagtatgacgaaataacatatattatgacaaactctaggtagaagggcagtacttacaccatcctaccgaggaacaattaccaagacacgtactgtatctacaagtcggacacgcctagagtacgcgtaggacggacgacggtctgtatacgttacgtggtaggggagtagggaacggacgggtaaagttacggggtaaacgttaggggtttcgggtgggggaccgtaacggggg

SEQ ID NO: 267064 - DNA, 778 bp, Homo sapiens
  misc_feature: GYAE6OF01C40ZW.28.57.F02.1.454.CMB.1.raw
  modified_base (681)..(681): a, c, t, g, unknown or other
  misc_feature (681)..(681): n is a, c, g, or t
  modified_base (692)..(692): a, c, t, g, unknown or other
  misc_feature (692)..(692): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggaggtagtttgggctgagtcgttgggttttccttgttgtcttaatttttaaaggtgtcctagtgtgaggtgcgagcgtgggtggagtcggtgggggaggtcgttcggtccgaggccggttcggggggtccctggaagtcctctccgtgtcgacacggtccttcgtacggtaacttcctaaccctttctaaggtttaactttaatgtacctaatcgtccgtaacggttcggggtaccccgaccgaaggtcccgtacccgggaaagggtaaaccggggtaacgttagggtaaaattgtacgttacccgtaagtaaggttaaagttaaggtaaaagttaaagcgtaaacgaaaattaaactaattaataaatttaacgagtaactaaacgtccgtaggaaagtaagggactaagtaacttaccaactaccgtactaaccgaaggtaaacctaaacgttaacgaaaacgtaaccgaacgttaccgtaagtacttactaacgaaacgttcgggacctaacggtccgttagaaacggcgtacgtacgggaacgaaccggnggtaccgttanaagtttaacgtggtagggaggagggtagagggtaacgtaaaggttacgggtaaaggttggggtacgggtgggtccggtaacggggg

SEQ ID NO: 267065 - DNA, 667 bp, Homo sapiens
  misc_feature: GYAE6OF01DTWUP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggtcttggtccagccgtggggggtccctgagactctcctgtgcagcctctggattcaccttcagttatttatgctatgcacgtgggtcccgccaggctccgaaggggaacggactggaatatgtctcaggttattagaagtaatgacgtaaataaacattaattaattatcgacaaacttctaggtaggaagggcagtattccgaacctatcctacccgaagggactaaacgttaccaaacgaaccacgtccttagtaacttcctttaacaacgtcggggacaacggtccctaaggaacgtacggtccgtagggaacgggaccgaacgggtccttaggtaaacttacgtttacggtggggttaggggaaggtaaaggggaggtaccgggtaaaggtttacggggaaaacgggtttaggggggtttagggtccggggggaccggtaaacgggggg

SEQ ID NO: 267066 - DNA, 796 bp, Homo sapiens
  misc_feature: GYAE6OF01BU9SC.28.57.F02.1.454.CMB.1.raw
  modified_base (310)..(310): a, c, t, g, unknown or other
  misc_feature (310)..(310): n is a, c, g, or t
  modified_base (322)..(322): a, c, t, g, unknown or other
  misc_feature (322)..(322): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcttgggttttccttgttgtcttaagtttttaaaggtgtccagtgtggaggtgcagcgtgggtggagtcggtgggggaggtcgttgggtccaggccggttcggggggtccctggacgtaccgttcctccgtgtcgacacgtcctcgtggtacttcctaccgttntagttaattttntgtactatcgaccgtacggtcggggtcccgaccgtacggtcccgtaccgggaaggggtaacggtacgttaggtaaatacgttacggttacctacggtaaggttaaacgttaaggtaaagttaaagtacggtaaacgtaaaacttaaaacgtaatttaaatttaacgttaagttaacgtaacctaaaaccgttcgtaaaggttagggaaacgggtacctaagtacgttaccgtaacctaacgttacccgtacccggtaaaggtaaacctaaccgttaaacccgaaaacgtaacccgtaccgttaccgttaggttaaacctaccgtttaacgaaagggttaccggactacggtaccgtaggaaggtacgtagtacgaacggaccgtaggtacctagttaacgtacgttggtaggtaggaggtaggacgggtaacgaggtttacggaggtttagggtggtacggggtggtaaccggg

SEQ ID NO: 267067 - DNA, 550 bp, Homo sapiens
  misc_feature: GYAE6OF01BDFO5.28.57.F02.1.454.CMB.1.raw
  modified_base (452)..(452): a, c, t, g, unknown or other
  misc_feature (452)..(452): n is a, c, g, or t
  modified_base (533)..(533): a, c, t, g, unknown or other
  misc_feature (533)..(533): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggctggaatatgtctcaggtattagaagtaatgacgaataacatatattatgacaaactctgtagaagggcagattcaccatctaccagggactaacttccaagaacacgactgtatcttacaatgggcagcctgagngctgaggacacggctagtactagttacgtcggtagggacggagggaggacgggtaagttcgggaacgttaggggtttcggngggggtcgtaacggggg

SEQ ID NO: 267068 - DNA, 604 bp, Homo sapiens
  misc_feature: GYAE6OF01BWW4P.28.57.F02.1.454.CMB.1.raw
  modified_base (376)..(376): a, c, t, g, unknown or other
  misc_feature (376)..(376): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtcgggtccgccgaggctccgaggggaagggactaggaatatgtctcgtaggtattagaagtaatgacgaaataacatatattanagactaaactctgtagaagggcagtacttcacctatcctaccgaaggtaacaacttaccaaagtaaccacgtctagtactcttacaaagtgggcaagcctaggacgagtcgtaggaacggaccgacggtcttagttattaagttacggtggttaggggaggtagggacggtacgggtaaagttcgggtaaacgggttaggggtttcggggtcggggccgtaacggggg

SEQ ID NO: 267069 - DNA, 688 bp, Homo sapiens
  misc_feature: GYAE6OF01CNB1J.28.57.F02.1.454.CMB.1.raw
  modified_base (261)..(261): a, c, t, g, unknown or other
  misc_feature (261)..(261): n is a, c, g, or t
  modified_base (386)..(386): a, c, t, g, unknown or other
  misc_feature (386)..(386): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctnggtattccaccttcagttatttatgctatgcacgtgggtcccgccgacggctaccggaggggaaggactagggaatagtgtctcaggtattaagaagtaatgacgtaaataacaattataattanagtacaaactcgtaggtacgtaagggactagtacttaccgaacctatccgtaccgaacgggaactaacttaccgaaagaaccacgtactagttactaccgttacaagttcgggactacggaccgtaggacggtacgtacgttagggaacggaccggtaaccggtacgttaggttaacgttaacgtttaaccggttagggtagggggaaacggtaacggggtaaggtaacggggtaaacggtttaacggggtaaacgggtttaggggtttacggggtcggggggtaccggtaacccggggggg

SEQ ID NO: 267070 - DNA, 714 bp, Homo sapiens
  misc_feature: GYAE6OF01B7NB4.28.57.F02.1.454.CMB.1.raw
  modified_base (611)..(611): a, c, t, g, unknown or other
  misc_feature (611)..(611): n is a, c, g, or t
  modified_base (638)..(638): a, c, t, g, unknown or other
  misc_feature (638)..(638): n is a, c, g, or t
  modified_base (656)..(656): a, c, t, g, unknown or other
  misc_feature (656)..(656): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacggagtttgggctgagcgttgggttttccttgttgtcttaattttaaaggtgtccagtgtgaggtgcagcgtggtggagtcgtgggggagtcgttgggtccaggccggttcgggggggtccctaggacgtacctcgtccgtggtcgccgtacggtccttcgtaggtaactttccaacccctttcaaggtttattttaagtcgaccttaattcggcctaacgttcgggggtccccaccgacggcctaccgaaggggaacgggtactaggtaaatagttcgtcgtacgtaaggttagttaaaggaaagttaataggaacgtaaaataaactaataattattaaatggtaacctaaaacgtcgttaggaaggaaacgggcaagtaagttaccaacgtaatccgtaacgaacgggaaactaacttaacccgaaagaaccacggtattacgttaactacttaacgaaacgtcgggacaacgtaccgnggaagtacgtcaggaaggcgaacggtntaagtagttaattacggnggtagggagaggaggtacgaaggttacggaaggtcgggttggcgggccggtaacgggg

SEQ ID NO: 267071 - DNA, 856 bp, Homo sapiens
  misc_feature: GYAE6OF01DH09L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgcttaagtttttaaaggtgtccagtgtgaggtgcagcgtggtggaggtcgtgggggaggtcgttggtccaggcccgtggggggtcccctggacgtacctcctccgtggtcgcacgtccttcgtggtacttcctacccttctagtttatttagtgtacttagtgctacgtcgggtcccgccgacggccgtaccggaaggggaacggtacgtaggtaatagtgtactacggtaaggttaattaaggtaaagtagtacgaaacgtaaaattaaactaattaattaaacgtttatacgtaaaccctaaaacgtttcgtaaggtaaggtaaacgggtacgtaacggttacttacccgaaccttaaccgttacccgtacccggtaaacgggtaaccttaaacgttaaacccgaaaacggtaaacccgaaccggtaccttaaggttaaaccctttaccgttaaacgtaaacgttacggggactaccggtaccgttaaggaacgggtacgtaccggttaaggaaccggaccggtaccggttacgttaacgttaaagtttaaaccggttacggttacgggggttaagggggtaaacgggtaaacggggtaaacgggtaacccggttaaaggggtttaaccggggtaaaacggggttttagggggtttacggggacccggggggtaaccgggtaaaccggggg

SEQ ID NO: 267072 - DNA, 554 bp, Homo sapiens
  misc_feature: GYAE6OF01BOAR6.28.57.F02.1.454.CMB.1.raw
  modified_base (399)..(399): a, c, t, g, unknown or other
  misc_feature (399)..(399): n is a, c, g, or t
  modified_base (455)..(455): a, c, t, g, unknown or other
  misc_feature (455)..(455): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtcgggtcccgccaggcctccgagggaagggactggaatatgtctcaggtattagaagtatgacgaataacatatattatgacaaactctgtgaaggcagatcacatcncgaggacaatccaaagacacgtctagtattcttacaaatcgggacagccctggagngctaggacggaccacggctagttatagttacgtggtagggaggtaggaggtacggtaagttagggaacggttaggggttgggtggggccggtacggggg

SEQ ID NO: 267073 - DNA, 628 bp, Homo sapiens
  misc_feature: GYAE6OF01AXBT8.28.57.F02.1.454.CMB.1.raw
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
  modified_base (469)..(469): a, c, t, g, unknown or other
  misc_feature (469)..(469): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctatttaagtgtcagtgtgagtgcagctggtggagtcgtgggggagcttggtccagccgtggggggtccctggacgctctcctgtcgcacggtcctcgtggtacttccaccttcgagttatttagtgtctatcgctacgttcgggtcccgccgaggcctccggaagggtaaggggacttaggatagtgtcgtagaggttagtaagtaaagtactgaacgtaaataacatatatttanacgactaaactcgtaggtacggaacgtnaagtactcacctactactcgaaggaactaagttaccaaaggaccncgtctaagtataccgttagaacgtgggacctacgaccgtagacggctatgggaacgtacgacgtctaggtatagttacgtagggcggtagggtaacggagggtacggtaaagttacggtaacggggttagggttgggttaacggggccggtaaacgggg

SEQ ID NO: 267074 - DNA, 683 bp, Homo sapiens
  misc_feature: GYAE6OF01BVAZS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgacgactctcctgtgcagcctctggattccaccttcagttatttatgctatgcacgtcgggtccgccgacggcctccggaaggggaagggactagggaatagtcgttactacgtaggttaattaaggaaagtaatgaacgtaaataactattaataattatacgtaactaaacgttcgttaggtagggaacgggactaaggtactttaccaaccgttactacccgtaccggtaaacgggtaaacctaacgttacccgaaaacgtaaccgtacggtacttagttaacttaccgttacgtaaaggttcgggacaacggtcctaggacgacgtcggtcgaaggaccgacggtcttaaggtattacggttagtcgggtagggaaggtagggaacggtaggtaagttacgggaacggttaggggttcgggcggggaccgtaacggggg

SEQ ID NO: 267075 - DNA, 616 bp, Homo sapiens
  misc_feature: GYAE6OF01CBGJP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtcgggtccgccaggcctccgagggaaggactaggaatatgtctctaggtattagaagtatgacaataacagtatattatagactaaactcgtgtaggaagggtacagtattccgaacctatccgtaccgaagggaactaacgttaccaaagaaccacgtcttagtacttcttaacgaagtcgggacacggtacctaggaacgagacgttacgggacggaccgtaacggtcgtagttaactagttacgtgggtagggaaggtacggacggtaacggtaagttacggggaacgtttaggggttcgggcgggggtacgtaacggggg

SEQ ID NO: 267076 - DNA, 737 bp, Homo sapiens
  misc_feature: GYAE6OF01CLKCW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggcgttggtccaggccgtggggggtccctggacgactctcctgtgcagcctctggattccaccttcagttattttatgctatgcctacgtgggtccgccgaggcctccgaagggggaacgggactagggaattagtggtaccttacgtaaggttaagtttaaggtaaagttaagtaggaacgtaaaattaaacgaatttaattaaatttaagtagaacccgtaaaactttcgtaggttaagggaaaggggtactaaggtacttaccaacctaacttcccgtacccgaagggaacctaaacttaccgaaacgaaccacgtacttagtacttacttaacgtaagtcgggacgacgtaccgtaggacgtacgacgtacggaacgggaccgtaccggtacgttacgttaagtttaacgtttaccggtagggttaggggaagggtaaggggtaacggtaacgggtaaacggtttaggggtaaacgggttaggggtttcggggtacgggggtacccgggtaaacggggg

SEQ ID NO: 267077 - DNA, 524 bp, Homo sapiens
  misc_feature: GYAE6OF01E38XM.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcccctggattcaccttcagtatttatgctatgcactgggtccnccaggctccagggaggactggaatatgtctcaggtattagaagtaatgacgaataacatatattatgcaaactctgtgaagggcagattcaccatctccagggacaattccaagaacacgctagtatcttacaaagtggacagcctgagagctagagacacggctgtatattacgtgtgggagagggagcggtaatggaacgtagggttggtggggccgaggggacg

SEQ ID NO: 267078 - DNA, 677 bp, Homo sapiens
  misc_feature: GYAE6OF01A0O2L.28.57.F02.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccaggccgtggggggtccctggagactctcctgtgcagcctctggattcaccttcagtatttangctatcgcacgtggtcccnccaggcctcgagggaggcnggaatgtgctcgaggtacttaggaagtatgacgaataacntaatattaatgactaaacttcgtagtaggaacgggcaagtactttcgaacctatcgtacccgaagggtaacctaacttcccgaaagaacccaccggtcctaggtaccttacgttaacaaggttcggggaccagggtacccgttaggaacggtaacgtcgttagggaacgggtaacccgacgggcgtttaagttaacgttaaggtttaacccgtggggttaacgggggaagggtacggtaagggtcccgggttaaaaggttccggggttaaaccggttaggggtttaggggtccgggggcccggttaaacggggg

SEQ ID NO: 267079 - DNA, 567 bp, Homo sapiens
  misc_feature: GYAE6OF01DTNBL.28.57.F02.1.454.CMB.1.raw
  modified_base (549)..(549): a, c, t, g, unknown or other
  misc_feature (549)..(549): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagtatttatgctatgcacgtgggtccgccaggctccgaggggaaggactggaatatgtctcaggtattagaagtaatgacgaataaacatatattatgacaaatctgtagaagggcagattacacaatctaccgagggacaaattaccaaacgaacacgctagtacttcttacaaatgggcaagcctagagagcgtggagacgacggcttagtatagttacgtggtagggaggtaaggaaggcgggtaaagttcgggaaacgttaggggtttacggngggggcccgtaacggggg

SEQ ID NO: 267080 - DNA, 774 bp, Homo sapiens
  misc_feature: GYAE6OF01ATJ6J.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtccctgagactctcctgtgcagcctcgtggtacttcctacctttctaagttattttagtgtccttatgacctacgtcgggttcccgccgacggtcccgtaccggaggggtaaaacgggtacgtagggtaaattacgttcgttaccgtacgtaaagggtttaagtttaaaggaaaagttaattacggaacgtaaaacttaaaacgtaaattaaatttaagtttaacgtacgtaaaccttaaaaaccgttcgtttaaggtaagggtaaacgggtacgtaaagtaacgttacccaaacccgtaattcccggtaacccggtaaagggaacccttaaacgttaacccgaaaacgtaacccgtaccgttcgttaacggttaacttccgtttaaacgaaaggttccgggaactaccgtcccgtaaggacggaacgtccgtagggaacggacgacggtcgttagtatacgttaggtcggtagggaggtacggaggtagggtaaagttcgggtaaacggttaggggtcgggtggggacccggtaacgggg

SEQ ID NO: 267081 - DNA, 752 bp, Homo sapiens
  misc_feature: GYAE6OF01CAVDS.28.57.F02.1.454.CMB.1.raw
  modified_base (265)..(265): a, c, t, g, unknown or other
  misc_feature (265)..(265): n is a, c, g, or t
  modified_base (609)..(609): a, c, t, g, unknown or other
  misc_feature (609)..(609): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtggggggagcttgggccagccgtggggggtccgtgagactctcctgtgcacgcctctggnttcaccttcagttatttatgctatgcacgttcgggtccgcccgacggcctcccgaaggggaacggggtacgtgggaatacgtgtcgttcctaagggttaattaaggtaagtaagtagacgaaataactataataacttatagacctaaactcgttaggtagggtaaacgggcgtaagtaacgtttaccaaccccgtaattccccgtaccggaacccgggtaataaacgtttaacccgaacggaaccacggtacccttggttaactttaccttaaccgtaaaggtcggtacggtacgtaccgtagggaagacgggtccgttaaggacgggaaccgttacccgggngtttaaacggtttagtaaaaccggttttgttacgggggttacggggaagggtaaacgggggacgttacgggggtaaagtttaaccgggggaaacgggtttttacgggggtgggggttaacgggggacccggggtaaccggggg

SEQ ID NO: 267082 - DNA, 734 bp, Homo sapiens
  misc_feature: GYAE6OF01DJ7G8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagcgtggtggagtcgtgggggaggtcttggtccaggcccggttcggggggtcccctggagaccttcctccgtgtgccacgcctcgtggtacttcctaccttcagttatttatgtactagtgctacgtcgggtcccgccgacggcctaccggaaggggaacggacgtaggtaaactagtgtctacgtaaggtagttaagtaaagtaagtacgaagtaaattaaacaattaattaattaacgtagtaacctaaatcgtaggtagggaaacggtctaagtaacttaccaacctacgttaccgtaccgaaggtaactaaaccgttaccgaaaagaaccctacggtacttacgttacttaccgttaacgtaaaggtcgggaacaccggtacgtggaacgtacgtacgtaagggaccggacgacgggttcttaacggttagtttaacgttaacgggtgggtaggggaagggaagggtacggtaagggttaaacggttacgggtaacggggttaggggttggggtacccggggaacgggtaacccggggg

SEQ ID NO: 267083 - DNA, 719 bp, Homo sapiens
  misc_feature: GYAE6OF01C1P56.28.57.F02.1.454.CMB.1.raw
  modified_base (245)..(245): a, c, t, g, unknown or other
  misc_feature (245)..(245): n is a, c, g, or t
  modified_base (260)..(260): a, c, t, g, unknown or other
  misc_feature (260)..(260): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggagcgttggtccgacgtcggggtccggtcgngacgtctctcgtgcncgcgtctgtagtactccttactagtatttatgtctatgcgacgtcgggtcccgccgacggacgtccgagggaagggacgacgtagtatgtctcgtaaggtagttaagtaagtaatagacgtaaataactaataattaattaatagaacaacctagtagtaggaaggaacgacgtattaccctaccaccttcgtacccgtaagggaacctaaacgttaccaaaaccgagaacccgtctaacgttactaacttaccgaaagtccggacgtactccgtaggtaacgacggtcgaacgggtagggaacccgtacggtccgttaaacgtttacgttaaagtttccgggtaagggtcggggggtaagacggggtaaaggggtaccgggttaaaggtacgggttaaacgggggttaacggggggttttggggaaccccggggcccgggtaacgggggttaaaccgg

SEQ ID NO: 267084 - DNA, 577 bp, Homo sapiens
  misc_feature: GYAE6OF01C2IG3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattcacctttcagttatttatgctatgcactgggtcccgccaggctccgaggggaagggactggaatatgtctcaggtattagaagtaatgacgaataacatatattatgacaaactctaggtagaagggcagtattccacctatcctaccgagggactaattaccaagaacacgctgtatcttacaagtggacagcctaggagtgcgtaggacggacgacggacttgtattagttacgtggtagggaggagggagtacgggtaagtttacggggaaacgttagggggttggtcggggggtccgtaacggggg

SEQ ID NO: 267085 - DNA, 543 bp, Homo sapiens
  misc_feature: GYAE6OF01A6XCU.28.57.F02.1.454.CMB.1.raw
  modified_base (492)..(492): a, c, t, g, unknown or other
  misc_feature (492)..(492): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgcaggctccgagggaaggactggaactatgtctcaggtatagaagtatgacgaataacagtatattatgacaaactctgtagaggcagattcacctatctccaggacaacttaccaagacacgctagtatctacaagtcgggacagacctgagtagctagacggacacggctagtatagttacgtggtagggaggnggaggacgggaagttcgggaacgttaggggttggtcggggccgtacggggg

SEQ ID NO: 267086 - DNA, 612 bp, Homo sapiens
  misc_feature: GYAE6OF01EDGNR.28.57.F02.1.454.CMB.1.raw
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctctggattccacttcagtatttatgctatgctacgtcgggtccnccgaggcctacgaaggggaggactggaatatgtctcgagtaatagaagtatgacgtaaataacatatataangacaaacgtcgtagagaagggcaagtattaccgactagtcctaccgaaggtaaccaacttaccgaaataaccgacgtactagttactctttaacgaaagttcgggacaacgtacgtaggaacgtaacgtcgtaggaacggtaccgtaacggccgttagtaacgtattacggtgggtagggaaggtagggaggtacggtaagttggaacggttagggttgggtcggggccgtaacgggg

SEQ ID NO: 267087 - DNA, 666 bp, Homo sapiens
  misc_feature: GYAE6OF01CG7PE.28.57.F02.1.454.CMB.1.raw
  modified_base (457)..(457): a, c, t, g, unknown or other
  misc_feature (457)..(457): n is a, c, g, or t
tcagagtacgctatcacgaccggtgctcgatttagctcgatatagttgggtcgtgggagaggagcccccgccctcgggtttcccaggtgttctcatttggtgatcagcactgcacacagaagagtcatgacggagtttgggctgagtcgttgggttttccttgttgtcttaagtttttaaaggtgtccagtgtgaggtgcagcgtgggtggagtcgtgggggagtcgttggtccaggtccgtcggggggtccctggagtactcgtccgtgtcgcagcctcgtggtacttcccacttctagttatttatgcttatgcgtacgtcggggtcccgccgacggccaccggagggaaacgggactagggaatagtcgtcctagtaaggttaattaagaaagttaagtagaacgaaataaactaattaataattattagaactaaatcgtagtaggaagggtnaagtactacaacctataccgtaccgaaagggtaactaaactaaccgaaacgtaaccacgtactacgttattacctaacgtaagtcgggactacgacgtgaagtagacgtaggaacgaccgaggtctagttaactagttacgtaggagggaggaagggaggtacggttaaggtacgggtaagttaggggtgggtaggggcggtaacgggg

SEQ ID NO: 267088 - DNA, 659 bp, Homo sapiens
  misc_feature: GYAE6OF01B2RGC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccaggccgtggggggtccctgagactctcctgtgcagcctctggattcaccttcagttatttatgctatgctacgtcggggtcccgccgaggcctaccgaaggggaacgggactagggaatagtgtctacgtaggttattaaggaaagtagtgacgtaaataacgaattataacttatagactaaactcgtaggtaggaacggactagtacttaccacctattccgtaccgtaagggaacctaaacttacccgaaacgaccacgtactagttactacgtttacaaacggtgggacacggcctaggacgtacggtctagggaacggtacgacgggtacttagttaattacgtttacggtgggtaagggaggtaagggacggtagggttaagttacggggtaacggttagggggttcgggtaggggggcccgtaacggggg

SEQ ID NO: 267089 - DNA, 667 bp, Homo sapiens
  misc_feature: GYAE6OF01EXOKJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaggactggaatatgtctcaggtatagaagtatgacgaataacatatattatgactaaactctaggtaggaaagggcagtaatttccaaccctattcctaccgaagggaacctaacgttacccaaacggaaccacgtccttagtactcttacaaagtgggacacggccgtaggaacggtagacgttaggaacgggtaccgaccgggtcttaggttaaacgttaacgttttaaccggtgggttacgggggaaagggtaggggtaacgggtaaccggggttaaacggtttacgggggtaaaaccgggtttaaggggggtttacggggttcgggggggtaacccgggtaaacgggggggg

SEQ ID NO: 267090 - DNA, 639 bp, Homo sapiens
  misc_feature: GYAE6OF01CSHCU.28.57.F02.1.454.CMB.1.raw
  modified_base (173)..(173): a, c, t, g, unknown or other
  misc_feature (173)..(173): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (398)..(398): a, c, t, g, unknown or other
  misc_feature (398)..(398): n is a, c, g, or t
  modified_base (536)..(536): a, c, t, g, unknown or other
  misc_feature (536)..(536): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttaaaggngtccagtgtgaggtgcagctggtggagtcgtgggggaggcttggtccgagccgtcggggggtccctgagactctccgtgtgcagcctcgtgattccactttcaagttattatgctagtnctactcggggtcccncgacggctaccggaggggaaggactaggtaatatcgtactcgtaggttaattaagaagtaactgaaccgaaattaacattaataatttagngaactaaaccgtgttaggaaggtaaacggcaagtacttacgacctatcctaccgaaggtacaacttaccaaagaacacgtacctatacgtacttaacgaagcgggacaacgcctaggagtacgcgtacgacgggaccncgggacttaagtaccgttaatacggttagggtgggaaggacggacggaggttaacggttaggtaaacggttgggttacgggtccggggtacggtaaacggggg

SEQ ID NO: 267091 - DNA, 772 bp, Homo sapiens
  misc_feature: GYAE6OF01B7V6E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgtcttatttttaaaggtgtcagtgtgaggtgcagctggtggagtcggtgggggaggtcgttggtccaggtcccggtcgggggggtccctggacgtacttccgtcctggtgcacgtcctcgtggtacttccacctttcagtttattttactgtcttagttcgcctacggttccggggtcccgaccgtacgggcctaccggaaagggggaacggggtacgttagggtaaacttagtcggttccttagtaaggttaagtttaaaggaaaacgttaaagtcgaaacgtaaaattaaacgaatttaattaacgtttaatacgtaacctaaacttcgtaaggtaggaaacgggctaagtacttccaacctactccgtaccggtaacggtaacctaaacgttacccgaaacgtaactaccgtctagtacttaccgttaacaaggtcgggactacggaccgtaggacggtacgtacggtacgggaacggacgtaccgggtcttacgttaagttacgttacggtggggtaaggggaaggtacggggaaggtaccgggttaaagggttacggggtaaacgggttgggggttacgggtacgggggtccgggtaaccggggg

SEQ ID NO: 267092 - DNA, 620 bp, Homo sapiens
  misc_feature: GYAE6OF01C744N.28.57.F02.1.454.CMB.1.raw
  modified_base (262)..(262): a, c, t, g, unknown or other
  misc_feature (262)..(262): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtcgtgggggaggcttggtccagccgtggggggtccctgagactctcctgtgcagcctcnggattcaccttcagttatttatgctatgcactgggtccgccaggctccgagggaagggctggaatatgtctnaggtattagaagtaatgacgaataacatatattanagacaaactctagtaggaaggcagattacaccatctccagggacaattaccaagaacacgtactagtacttacttacaaagtcgggactacgtacctaggaggacgtacggtggaacggtaccggaacggtccgttagtaactttacgttaacgtgggttagggggaagggaagggaacgggtagggttaaacgtttacggggtaaaggttacgggggttttagggcggggggtcccggtaaacggggggg

SEQ ID NO: 267093 - DNA, 733 bp, Homo sapiens
  misc_feature: GYAE6OF01E5CN2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggaggtcgtgggggagtcgttggccaggccggtgggggtccctgagtactctccgtgtgcacgtcctgtgtacttcctaccttctagttatttatcgtcttagtcgctacggtcgggtccccgtccgagggtcctaccggaaggggaacgggtacgtaggaaatacgtgttacctagtaacggttaattaagaagttaagtaggacgaaaagtaaactattaattaattagtacgaactaaacgttcgtaggtaggaacggtcaacgttactaccgaacctacgtaccgtaccggaaagggaaccttaaacgttaccgaaaacgtaaccgacgttacgttagtacttacctaagtaaacggtgggaacctagtcccgtagaggtacgtcgtacggtaacggaccgtacggtcgttagttacgtaaccgtttaggtcgggtaggggaacggtacgggtacgggtaacggttaaacgggttacggggtaacgggtttagggggttcggggtaccgggggccggtaaaccggggg

SEQ ID NO: 267094 - DNA, 561 bp, Homo sapiens
  misc_feature: GYAE6OF01BEDP2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccaggccgtggggggtcccctggagactctccctgtgcagcctctggattcaccttcagtatttatgctatgcactgggtccgccaggctccgaggggaaggactggaatatgtctcaggttatagaagtatgacgaataacatatattatgacaaactctgtagaagggcagtattcactatctccaggaacaacttaccaagaacacgtctagtactcttacaagtcgggactagacctgagagtctaggaggacacggctagtatattacgtggtagggaggaggaggcggtaaagttcgggaacggtttaggggttgggtcggggtccgtaacgggg

SEQ ID NO: 267095 - DNA, 547 bp, Homo sapiens
  misc_feature: GYAE6OF01DIBF6.28.57.F02.1.454.CMB.1.raw
  modified_base (294)..(294): a, c, t, g, unknown or other
  misc_feature (294)..(294): n is a, c, g, or t
  modified_base (367)..(367): a, c, t, g, unknown or other
  misc_feature (367)..(367): n is a, c, g, or t
tcagagtacgctatcacgaccggtgctcgatttagctcgatatagttgggtctgggagaggagccccgccctgggtttcccaggtgttctcattggtgatcagcactgcacacagaagagtcatgacggagtttgggctgagctgggttttccttgttgctatttttaaaggtgtcagtgtgaggtgcagctggtggagtctgggggaggcttggtccagcctggggggtccctgagactctcctgtggcagcctctggattcaccttcagtattatgctatgcactgggtccncaggctcgagggaaggctggaatagtgtctacgaggtaattagaagtaactgacgtaataacagtaatattangacaaactctgtagaagggcagtattcactatctaccaggacaattcaagtaacacgtctagtactcttacaaagttcggacaagccgtagagtagctgacggacacggtctagtatattacgtggtagggagaggagtcggaagttggaaacgttgggttaggtggggtcgaacggggg

SEQ ID NO: 267096 - DNA, 636 bp, Homo sapiens
  misc_feature: GYAE6OF01D0GGV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattcaccttcagttatttatgctatgcacgtcgggtcccgccaggcctccgaggggaagggactaggaatagtgtctcgtaaggtattagaagtaatgacgaaataacattaatattatagactaaactcgtagtaggaagggcagtattccaaccctatcctaccgaaggtaacctaaacttacccgaaaagaacctacgtacttacgtaacttaccttaacgaaagttcgggactacggtaccctaggaacgtacgtcgtaggaacgggaccacgggtcttaggttaataagtttacggtgggtagggaaggtagggacggaggtaagttagggtaacggttaggggttcgggtcggggacggtacgggg

SEQ ID NO: 267097 - DNA, 729 bp, Homo sapiens
  misc_feature: GYAE6OF01C9FMD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctcgtggattcaccttcagttatttatgctatgcacgtcgggtcccgccgaggcctccgaaggggaacgggactggaatagtgtctcgaggtattagaagtaatgacgaaataacattaataattatgaactaaactcgtaggtaggaaacgggctaaggtacttaccgaaccctaacgttcctacccgaaagggtaacctaaacgtttaacccgaaacggtaaaccctaaccggtacctttagttaactttaccgtttaaccgtaaaaggtccggggtaactaaccggtacccgttaaggtaacgggaacggtacgtacgggaacgggtacccgacgggtaccgttagtaaacgtttaagttaccggttaggggtaggggtaagggtaacgggaagggtaacgggtaaaggtttacggggtaaacggtttaggggggtttacgggtcggggggtacccggtaaacgggggg

SEQ ID NO: 267098 - DNA, 881 bp, Homo sapiens
  misc_feature: GYAE6OF01D8U6A.28.57.F02.1.454.CMB.1.raw
  modified_base (289)..(289): a, c, t, g, unknown or other
  misc_feature (289)..(289): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcttgggtccaggccgtggggggtccctgacgtactctcctgtcgcacgtcctgtggtacttcctaccctttntaagttattttaagtcgtacttagtcgtacctacggtcgggttaccccgccgtagggtcccttacccggaaggggaacggtacgtagggtaaacttacgttacggtccttaaggtaaggtttaaagtttaaaggtaaaacgttaagtacggtaaaccgtaaaaattaaacttaaatttaaatttaacgtttaagtaacggtaaaccttaaacccttaggttagggtaacgggtaaacgggtaccctaaggttaaccgtttacccaaacccgtacttacccggtaaccggaaaacgggttaaaccaaaccgtttaaacccggaaaacgtaaaccccgtacggttaaccctttaaggtttaaccttaaccggtttaaaccgtaaacgggttcgggtaaaccctcggtaacccggttaaggaaggaacccgttaaccgggagggaaacccgggtaccgtaaccgggtacgttaagttaaacgtttaaacgtttaccggtaacgggggttagggaagggtaaccgggaagggtaaaccggttaaggttaaccgggtaaggtttagggggttcgggtacggggaccggtaaccgggg

SEQ ID NO: 267099 - DNA, 772 bp, Homo sapiens
  misc_feature: GYAE6OF01BB8K9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccaggcccgtggggggtccctgagactctcctgtgcagcctcgtggacttccaccttcgtaagttattttatgtctatcgcacgtcgggtcccgccgaggccgtccgaggggaacgggactaggaattagtcgttctacgtaggttacttaagtaaagtaactaggaacgtaaagttaaactattaagtaatttaagtagtaacctaaaacttcgttaggttacggaaacgggtactaacggtaactttacccaaacccgtacttacccgtaaccgtaaacgggtaacctaaacgttaacccgaaacgaaccctaacgtcgttacgttaacttacgtttaacgaaagttcgggaccgtaaggtcccgtaaggacggtaacggtacgtacggtaacgggaaccgtacgggtacgttacggttaaagttaacgtttacggtaggggttaacggggaagggtaacggggacgggtaacggttaaagggtttacggggttaaaccgggttaagggggtttacggggttccggggggtaaccggtaacccgggggg

SEQ ID NO: 267100 - DNA, 826 bp, Homo sapiens
  misc_feature: GYAE6OF01CMRZA.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagtcttgggttttccttgttgcttatttttaaaggtgtccagtgtgaggtgcagcgtggtggagtcgtgggggagcgttggtccaggtccgtcggggggtccctggagactcctcctgtgccacgcctcgtggtactttaccacctttcgtaagtttaattttatcggtaccttatcggtaccgtaaccgttcgggggttacccccgccggaacggtcccgttacccgggaaacggggggtaaacgggtaaccggttaagggtaaagttacgttacggtttaccgtaaccggtaagggtttaaagtttaaaggtaaaaggtttaaagtacggtaaacgtaaaaacttaaaacgtaagttaaatttaagtttaactacggaacctaaaccgtttacgtaggtaacggaagggtactaagtacttaccaacctacgttaccgtaccggaacggtaactaaacgttaaacccgaaagtaacccgacgtacttaacgtacttaacttacgaaacgtgggacaaccgtacgaggtaacgtagtacgtaggacgacgtacggtacttagttaagttaccgttacggttagggtagggaagggtaacggggacggtaagggttaaacggttacggggttaaacggggttacggggtttacggggtacggggggtacccgtaaccgggggg

SEQ ID NO: 267101 - DNA, 167 bp, Homo sapiens; identical to SEQ ID NO: 266719
  misc_feature: GYAE6OF01DK9HE.28.57.F02.1.454.CMB.1.raw
  modified_base (165)..(167): a, c, t, g, unknown or other
  misc_feature (165)..(167): n is a, c, g, or t

SEQ ID NO: 267102 - DNA, 815 bp, Homo sapiens
  misc_feature: GYAE6OF01DGM5V.28.57.F02.1.454.CMB.1.raw
  modified_base (175)..(175): a, c, t, g, unknown or other
  misc_feature (175)..(175): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcgagtcgtgggtggtagtcgggtagggggacggtcgttccggtaccgacggtcccgggggttccggggggttccctaggaacgtacccttcccgttccgttggtacgacgaccgtcccgttcggtaggttaacttccctaacctttacgtaagttttaatttagtcgtacttagtcgtacctacggtccgggtcccgaccggtacggtccgtaccggggaaggggtaacggacggtaggtaaatgtacgttactaggtaggttaaagttaagtaaagttacgtacggtaacgtaaaactaataattaatttaattacgtacgtaacctaacgttagtaggtaacggaaggtactaagtaccttaaccacgtactccgtaacggacgtaaactaactaacgaagaacctacgtctaagttacttacgtaaacgaagggtcgtaacgaccgtgtaacggagacggtagtaacggacggtaaccggtgtaaccgtttaagtaaccgtttaaggtttacggtaggggggtaacgggaaggggtaacgggaagggtaaccggtttaaagggttaacgggtaaacggggtttgggggtttacgggggccgggtaaccggggtaaaccgggg

SEQ ID NO: 267103 - DNA, 811 bp, Homo sapiens
  misc_feature: GYAE6OF01B9Q6Q.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttagttttaaaggtgtccagtgtgaggtgcagcgtggtggagtcggtgggggaggtcgttcggtccacggccggtggggggtccctggacgtactcgtccgtgtcgcgacgtcctcgtggtacttacctacccgttctagttatttagtcggtactagtcgccgtacggtcggggtccccgaccgacggcctaccggaaggggaacggtacgtagggtaattaaggtcgtaccgtacggtaaggttaacgttaaggtaaagttagtacggtaacgtaaaattaactaaattaagttaattaacgtacggtaactaaacgtcgttaaggtaagggaacggtacgaagttactaaccgtaactacgtcccggtaaaccgaacggtaaactaacgttaaacccgaagtaaaccgtacgtactttaacggtactaaccgttttaacggaacgtacgggaccgtaacggtacgtaggtaaacggacgtacggtaccggtaggaacccggtacccgtagtttaaggttaaaccgttaccggttaagggtacggggtaaggggaacgggtaaggggacggtaaacgggttaaacgggttaaggggtaaacgggttgggggttacgggtaccgggggtacggtaaacccgggggg

SEQ ID NO: 267104 - DNA, 762 bp, Homo sapiens
  misc_feature: GYAE6OF01CFHJI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcgttgggttttccttgttgtcttaatttttaaaggtgtccagtgtgaggtgcagctggtggagtcgtgggggaggcgttggtccaggccgtggggggtccctgagtactctcctgtgcacgcctgtggtacttccaccttctagttatttagtcgtctagtcgacctacggtcggggtcccgccgacggtccgtacccggagggggaaacgggtaccgtagggtaaattacgtcggttaccgtacgtaaggttaagttaaggtaaagttaacgtacggtaacgtaaaattaaactaagttaatttaagtttaacgtacgtaaactaaaaccgttcgttaggtaacggaaagggtactaaggtacttaccgaactacgttccgtaacccggaaacgggtaactaaacgtaaccaaacgtaaccgtacgtacgttagtactttaccgtaataacggtgacgtacgtacgtaggagtacgtacgtaggacgtacggtacgtacttacggtaattacggtacgttgggtaagggaagggtaacgggtaggtaacgggttaaacggttacgggtaaacgggtttggggttaaccggggtcggggaaccgggtaaaccgggg

SEQ ID NO: 267105 - DNA, 734 bp, Homo sapiens
  misc_feature: GYAE6OF01BG4P2.28.57.F02.1.454.CMB.1.raw
  modified_base (281)..(281): a, c, t, g, unknown or other
  misc_feature (281)..(281): n is a, c, g, or t
  modified_base (646)..(646): a, c, t, g, unknown or other
  misc_feature (646)..(646): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttagttttaaaggtgtccagtgtgaggtgcagcgtggtgagtcgtgggggagtcgttggtccaggccgtgggggtccctggacgctcgtcctgtgcagcctgtggtattccaccttnagttatttatcgctatcgactcgtcgggtacccacgacggcctaccggagggaaggtctaggtaatacgtacgtcgtagtaaggttaagtaagtaaagtactcgaaacgtaaactaaatattaaagtagtttaactacggaaccttaaacgttccgtaggtaaagggaacgggtactaacgtactttaacccgaaccttaacgtccccgtaacccggtaaaggtaaactaaaccgttaaccgaaaacggtaaccgactaccgttaagtaccttacgtttaaacgaacggttcgggacctacggaccttaggaaggtaacgtccgagggaacgaccgtacggttatacgtaacttaacggttaagnggggttagggaacggtaggggtaacgtagggttaaacgttacgggtaacgggtttaggggttacgggccggggtacgtaaaccggggg

SEQ ID NO: 267106 - DNA, 596 bp, Homo sapiens
  misc_feature: GYAE6OF01BJN8G.28.57.F02.1.454.CMB.1.raw
  modified_base (284)..(284): a, c, t, g, unknown or other
  misc_feature (284)..(284): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttangctatgctacgtgggtcccgccgaggcctccgaaggggaagggactaggaattatgtctcgaaggtattaagaagtaatgacgaaataacataatattatcgacaaactcgtagtagaagggcaagtacttccaacctatacctccgaagggaactaacttaccaaagaccacggtctagtactaccttanaaagtgggacagcctagaagtacgctaggaacgacgacggtctagtacttacgttacggtggagggaggaggaggtacggtaagttacgggaagttaggggttggaggggtcgtaacgggg

SEQ ID NO: 267107 - DNA, 951 bp, Homo sapiens
  misc_feature: GYAE6OF01EN5Y4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagcgtggtggagtcgtgggggaggtcgttcggtccaggtccggtggggggtcccctgacgtactccgtccgtggtcgctacgccttgtggtacttcctacctttcgtagttattttagtcgtaccttagttggaccgtaccgttcgggggttaccccgcccggaacggggtcccgtaccgggtaaacggggggtaaacggggtaccgttaggggtaaattacggttacggttaccttacgggtaagggttttaaaaggtttaaagggtaaaacggtttaaagttacggtaaaccgtaaaacttaaaccgtaaatttaatttaaacgtttaaggtaccggtaaaccttaaaaccggtttggttaacggggttaacgggaaacggggtacgttaacggttaactttacccaaacccctacgttacccgtaacccggggtaacgggtaaaacctaaacgttacccgaaaacgaacccgtacccggttaccgttaagtttaacccgtttaaccttaaacggtaaaccgggttgggggtaaccctaaccggtacccggttaaggaaccggtacggtaccgggttaacggaaccgggtaccgaccggggttccgttaaaggtttaaccgttaacgtttaccgggtaggggtttaacgggggagggtaaaccggggtaaacgggtcgggttaaaaacgggtttcgggtaaaacggggtttaggggggttaccggggtaacggggggtaccccggttaaaccggggggg

SEQ ID NO: 267108 - DNA, 564 bp, Homo sapiens
  misc_feature: GYAE6OF01CKNT1.28.57.F02.1.454.CMB.1.raw
  modified_base (383)..(383): a, c, t, g, unknown or other
  misc_feature (383)..(383): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcttggtccagccgtggggggtccctgagactctcctgtgcagcctctggacttccaccttcagttattatgctatgctacgtggtcccgcaggcctcggaggggaaggactaggaactagtcgtactcgtaggtattaagaagtaagtgacgtaaataacataatattagnactaaactgtgtagaggcagtactacactatcacgaggactataccaagacagtctgtactctacaagtcggacacgtcagacgagtacgtgaacgacgcgtacgtagtactagttacgtggtagggagtagggagtacgggtaagtggtaacggtagggttcggtgggccggtaacgggg

SEQ ID NO: 267109 - DNA, 657 bp, Homo sapiens
  misc_feature: GYAE6OF01C7PND.28.57.F02.1.454.CMB.1.raw
  modified_base (414)..(414): a, c, t, g, unknown or other
  misc_feature (414)..(414): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggaggtcttggtccaggtccgttcggggggtcccctggagtacctctccgtgtcgcgagcctctggtatttccacctttcgaagtttattttagtgcttaatgcacgttcgggtcccgcgacggctccggaaggggaaggactagggtaatagtcgtctacgaggttaattaagaagtaatgacaaataacatattaattangaacaattcgtagaggaaggactagtacttacaccattaccgtaccgaaggtaactaaacttaaccgaaacgaacacgtacttatacttacttaacaaaggtcggacgacgacctacggaagccgtaggtagacgggaccgaacggtcttaggaagttagttacgtggggtaggaggaaggacgggtacggtaaggttacggtaacgggtttaggggtacggggtgggacccgggtaacgggg

SEQ ID NO: 267110 - DNA, 568 bp, Homo sapiens
  misc_feature: GYAE6OF01BOW8J.28.57.F02.1.454.CMB.1.raw
  modified_base (302)..(302): a, c, t, g, unknown or other
  misc_feature (302)..(302): n is a, c, g, or t
  modified_base (405)..(405): a, c, t, g, unknown or other
  misc_feature (405)..(405): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggattcaccttcagtatttatgctatgcacgtgggtccnccaggcctccgaggggaagggactggaatatgtctcaggttattagaagtaatgacgaaataacatatattatgacaaactctggtagaagggcagattcacntctcaggacattaccaagacacgctagtatcttacaagtgggcacgcctagagagactggaaggaccgacggctagttacttagtttacgtggtagggaggagggagtacgggtaaattacggggtaaacgttagggggttgggtgggggcccgtaacggggg

SEQ ID NO: 267111 - DNA, 728 bp, Homo sapiens
  misc_feature: GYAE6OF01DGP7D.28.57.F02.1.454.CMB.1.raw
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctcgtggtacttccaccttcgagttactttatgctatgcacgtcggggtcccgccgacggcctaccggaaggggaacggggtaccgtagggtaattagttcgttcgtacgtaggttaacgttaaggaagttaatcggacgaaataaacgtattaattaattatgaacaaacgttctaggtacggagggacagtacttaccacctattcccgtacggaagggtaacctaacgttaacccgaagtaaccgacgtcttagtaacgttccttaacgaaacggtgggactaacggtcccgttaaggaacggtacggtacgttacggaacgggtaccgtaccgggtacttacggttaaatttacggttaaccggttagggtagggggtaaggtaaacggggtaaggtaaccgggttaaagttacggggtaaaacgggtttgggggtttacgggaccgggggtcggtaaaccgggggg

SEQ ID NO: 267112 - DNA, 801 bp, Homo sapiens
  misc_feature: GYAE6OF01ATQKN.28.57.F02.1.454.CMB.1.raw
  modified_base (176)..(176): a, c, t, g, unknown or other
  misc_feature (176)..(176): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttccttgttgcttaagttttaaggntccagtgtcgaggtgctagctagggtggacgtcgtgggggagtcgttggccaggtccggtgggggtccctgacgtactctccgtgtcgcgacgtccttcggtggtacttccgtaccgtttgtaacggttatttacggtcggaccttaacgttcggaccgtaccggttcgggggttaccccgccgtacggggtacccgttaccggaaggggtaaacggtcgtaaaggtattacgtcggttacgtacgtaagggttaacttaggtaaacgtacgtaacggacgtaaacgttactaacgtttagtaacgttacgtacggtaacccgttaaacttcgggtaacggtaggtaaaccgggtcgaaacgtttacgtacctaacggtccgttacgtaccggtaacgggtaactaccgtaaccgtaaacggtacccgtacgtaccgttaacgtaccgtttaccgaacggttaacggtccggacgttaaccggtaccggttacgacggttaccgacgtacgggtaccgtaccggtccggtagttaccgttagtacgttacggcgggtaggtacggtacggtaacggtggttaacggtcgggttaaacggtgggtacgggtcggaccggttacggg

SEQ ID NO: 267113 - DNA, 766 bp, Homo sapiens
  misc_feature: GYAE6OF01BGKFH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgagtgcagctgggtggagtcgtgggggaggtcttggtccaggccggtcggggggtcccctggacgactctccgtgtgcacgcctcgtggactttccacctttctagttattttatcgtactagtcgctacggtcgggtccccgccgacgggtccgtaccggaagggggaacgggtacgtagggtaaacttagtcgttaccgtacgtaaggttaagttaaggtaaagttaacgtagaacgtaaataaactaattaattaagttaatacgtaacctaaacgttcgtaggtaaggaacggggtactaaggtacttaccgaaaccttacgtaccccgtaaccggaaacgggtaaactaaccttaaccgaaaacgtaaccgaccgtcttacgttaacttaccgttaaacgaaggttcgggacaaccggtaccaggaaggtcgacggtaggaacggaacccgtaggtcgttaagttaagttaccgtttagggtaggggtagggaagggacggggaaggtaacgggtaaagtttaacggggaaacggtttaggggggttacgggaccgggggtaccggtaacggggg

SEQ ID NO: 267114 - DNA, 692 bp, Homo sapiens
  misc_feature: GYAE6OF01CJB0Z.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaggtgtccagtgtgaggtgcagctggtggagtcgtgggggaggcttggtccagccgtggggggtccctgagactctcctgtcgcagcctcgtggtacttccaccttcagttatttatgactatgctacgtcgggtcccnccgaggcctaccggaagggaagggactaggaacttagtgtctacgtaggttattaagaagttaagcgacgaaataacatataatatagactaaactcgtagtaggaaggctagtacttacgactactccgtacgaggtaactaacgttaaccaagaacctacgtactagtattaccgttaacgaagttgggactaacgtaccgtaggtaacgaggtaccgtagggaacggtaccgtaaccgggtgttaaggtaacttaggttaacggtacgggtaaggggtaacgggtaaggggtaacgggttaaacggggttaaacggttaacggggtaaacggggtttaggggggttacggggttacggggggaaccgggttaaacccggggg

SEQ ID NO: 267115 - DNA, 844 bp, Homo sapiens
  misc_feature: GYAE6OF01DKGD8.28.57.F02.1.454.CMB.1.raw
  modified_base (238)..(238): a, c, t, g, unknown or other
  misc_feature (238)..(238): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcagtgacggtaggtttgggctgagtcgttgggttttccttgttgtcttaagttttaaaggtgtcagtgtgaggtgcagtcgtggtggagtcggtgggggagtcgttggtcccgnggccggttcggggggtccctggacgtaccttcctccgtgtcgcacgtcctacgtggtacttaccacctttcgtagtttaatttgtcgtcttagtcgtccgtacggttcggggtacccccgaccgtacggcccgttaccgggaaaggggaacgggtaccgtaagggtaaactttagttcggttaccgtacggttaaggttaaagtttaaggaaaagttaagttacggaacgttaaaaactaaataattaacgttattaacgtcgaactaaacgttctaggtaacggaaggactaagtacttaccaactcgttacctacggaacggtaaactaaaccgttaaccgaaacgaaccgtacgtacgttacgttacttaaccgtaaccgtaaaggtccggaacctaacggacccgttaaggaacgacgtacggtacgggtaaccggtaccgggtaacccggttacgttacgttaaaccggtttaacgtttaacgggtgggtaacggggaaaggggtaaccgggtaaggggttaaccggttaaaggggtttaaaccgggttaacgggtttagggggtttaccggggtaggggggaacccggtaaacccggggg

SEQ ID NO: 267116 - DNA, 707 bp, Homo sapiens
  misc_feature: GYAE6OF01CYEL1.28.57.F02.1.454.CMB.1.raw
  modified_base (291)..(291): a, c, t, g, unknown or other
  misc_feature (291)..(291): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagcttggtccagccgtgggggtccctgagactctcctgtgcagcctgtggattccaccttcagttatttatgctancgcacgtcgggtcccgccgacggcctaccggaaggggaaacgggaccgttagggaaattagtcggttctacgaagggttaatttaaggaaaagttaatcggaacgtaaattaaacgaattaattaatttaatgaaacctaaactttcgtaggtacgggtaaagggacctaagtacttaccaaccctactaccgtacccgaagggtaactaaacgttaaccaaacgtaacaccgtcttagtaacttcttaacgaagtcgggactacgcctaggaggagtcgaggaacggaccgaacggtcgttacgtaacgttagtttaccggtagggtaggggaaggaaggggtacggaaacgggttaaggttaacggggtaacggtttaaggggtttacgggggccggggaaccggtaacggggg

SEQ ID NO: 267117 - DNA, 940 bp, Homo sapiens
  misc_feature: GYAE6OF01B6VOU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaggtgtccagtgtgaggtgcagctggtggagtcgtgggggagcgttggtccagccgtcggggggtccctgacgactctcctgtcgcagcctctggacttcaccttctagttatttatgtcttagtgctacgtcgggtccgaccgaggcctaccggaaggggtaacgggacgtagggtaacttagttcggttccttacgtaacgggttaattaaaggtaaaagtttaacgtacggtaaacggtaaaacttaaaccgtaaagttaaatttaacgtttaactacggtaaccttaaaaccgtttcgtaaggtaacgggtaaacggggtaccgtaaggttaacctttacccgaaaccttacgtttaccccgtaacccgggaaacggggttaaaccctaaaaccgtttaacccggaaaaacgggtaaacccctacccgggttacccttttaaaggtaaacccttttaccgtttaaacccggtaaaagggttacccggggaacgttaacccgggttaacccgttacggggtaaacgggtaaccgggttaccccgggttaagggtaacccggggtaacccggttaacccggggttcggttttaaaacggttaacgttttaaacggggttttaacggttcgggggttaaagggggttaaacggggaaaggggttaccggggttaaaacgggtttaaccgggtttaacggggggtaaaaccgggtttttagggggggttacgggggtaaacccgggggtacccgggggttaaaccggggggg

SEQ ID NO: 267118 - DNA, 725 bp, Homo sapiens
  misc_feature: GYAE6OF01DER2W.28.57.F02.1.454.CMB.1.raw
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcttggtccagtccgtcgggggtccctgagtctctcctgtgcacgctcgtgtacttccaccttctagttatttagtgtctatcgctacgtcgggtcccncgtaggtccgtaccggaaggggaacgggacgtaggtaattagtcgtacctgtaaggtattaaggaatagtagtaacgtaaataactaatttaactaatttagtacgtaacctaaactttcgtaaggtaggaacggactaagtaacttcccaaccgtactacccgtaccggaaggtaacctaacgttaacccgaagtaacctaccgttactacgttaacttacctttaacgaaaggttccgggactaaccgtcgtacggaagtacgtacggtagacggaccgtacggtacgttacgttaaacttacgttacgggtagggtaaggggtaggacgggtaacgggtaccgttaaaggggttacgggtaacggttaggggggtttacgggtcggggtaaccgggttaaccggggg

SEQ ID NO: 267119 - DNA, 722 bp, Homo sapiens
  misc_feature: GYAE6OF01B19KB.28.57.F02.1.454.CMB.1.raw
  modified_base (593)..(593): a, c, t, g, unknown or other
  misc_feature (593)..(593): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggggaggtcgtttggtcccgaggcccggtcgggggggttcccctggagacctctcctgtgcagcctcgtggacttcaccttcagttatttatgctatgcacgtgggtccgccgaggcctaccgaggggaagggaccgtagggaatagtgtctacgaggttaattaaggtaagtaagtggaacgtaaataaacgtattaattatttaatacgaactaaactcgttaggtaggtaagggtacaaggttacttacccgaactagttccccgtaaccggaagggtaaacccttaacgttaaccaaaacggtaaccctaacggttacttaacggttaccttaccgtttaacgtaaaggtcgggacctaacggtaccgtaggagtaccgnggttaacggacgggaccgtacggtcgttagtagtttaacgtcggttagggtacggggaaggaagggacgttaagggtaacggttacgggtaacggtttaggggtcggggtcggggaccgtaaacggggg

SEQ ID NO: 267120 - DNA, 783 bp, Homo sapiens
  misc_feature: GYAE6OF01D6E9N.28.57.F02.1.454.CMB.1.raw
  modified_base (309)..(309): a, c, t, g, unknown or other
  misc_feature (309)..(309): n is a, c, g, or t
  modified_base (338)..(338): a, c, t, g, unknown or other
  misc_feature (338)..(338): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttggttgtcttaagttttttaaaggtgtccagtgtgaggtgcagcgtggtggagtcgtgggggaggtcgttggtccaggccggttcggggggtcccctggacgactctccgtgtgcagcctcgtggtacttcctaccttcagttactttangtcttagtcgcgtaccggtcggggtcccnccggacggcctaccggaaggggaacgggacgtaggtaacttagtcggtacgttacgtagggttaactttaaggtaaagttaacgtacggaacgtaaaactaaagtattaagttattaatacgaacttaaacgtcgttaagtaggaaacgggactaagtaacttccaaaccgtacgttaccgaaccggtaagggtaaactaacggttaaccaaacgtaaaccgtccggttaacttagttaacttaccgttaacgtaaacggtgggtacgaccggtccgtaaggacggtacgtacggtacggaaccgtacgtcggtacgttaaggtactttacggttagggaggggttagggaaggaacgggtacgggttaacgggttaacggttaacggggtaacgggggtttaagggggtttccggggtaacggggtcccggggtaaaccggggg

SEQ ID NO: 267121 - DNA, 733 bp, Homo sapiens
  misc_feature: GYAE6OF01EE2OO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccaggccgtggggggtccctggagactctcctgtgcagcctctggattccaccttcagttatttatgctatgcacgtcgggtcccgcacggctccgagggagggactaggaatatgtctcgaggtattagaagtatgacgaaataactattataatttatagtactaaactcgtaggtaggaagggactaagtacttaccaaccattccccgtaccgaacgggtaacctaaacgttacccaaacggtaacccgacgtaccttaaggtactttacccgtttaacgaaacggttcggggactaacggtcccgttaaggaacgggtacgtacgttacgggaacgggtacccgtaaccgggtacgttaacggttaacgtttaaggtttaaccggttaggggttagggggtaaacgggagggggtaaaaccggggtacgggttaaagggtttacggggtaaaacggggttttaggggggtttaggggtccggggggtaacccggtaaccggggggg

SEQ ID NO: 267122 - DNA, 589 bp, Homo sapiens
  misc_feature: GYAE6OF01CJVE1.28.57.F02.1.454.CMB.1.raw
  modified_base (205)..(205): a, c, t, g, unknown or other
  misc_feature (205)..(205): n is a, c, g, or t
  modified_base (254)..(254): a, c, t, g, unknown or other
  misc_feature (254)..(254): n is a, c, g, or t
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
  modified_base (453)..(453): a, c, t, g, unknown or other
  misc_feature (453)..(453): n is a, c, g, or t
  modified_base (466)..(466): a, c, t, g, unknown or other
  misc_feature (466)..(466): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgtggtttcgtgtagctatttaagtgtcagtgtgagtgcagtctggtggagtgtgggggngcgttggtccagtccggtggggtcctgagctcgtcctgtcgcagcctgnggtcttcaccttgtattattatgctatcgcncgtggccgcagtcncgagggagacagatctagtctagagtattaacgaagtagagtacaataaactatacttatagtgactaaacgttgaggtaggaggactagtactacgacctactccacgaacggactaacttaaccaacgaactacgtctagtattaccgtaanaacgtcgcgacgngtacgagtagactaggacgaccgtaggtactagttagtaaccgttagggttgggaaggtgggaaacccggagttaacggtaggttacggtaagggttggtaaccgggtgggaaccggtacggg

SEQ ID NO: 267123 - DNA, 722 bp, Homo sapiens
  misc_feature: GYAE6OF01EJ717.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtgggggtccctgagacctctcctgtgcagcctctggattccaccttcagttatttatgctatgcacgtcgggtcccgccgaggcctaccggaaggggaacgggtacgtaggaatagttcgtctacgtaaggtttaattaaggaaagttaagtacggacgtaaaattaaactaattaattaatttaatagacctaaaacgttcgttaggtaggaaagggtactaaggtacttaccgaaccctagtaccctaccgaagggtaacctaacgttaccaaacgtaaccgtacgtacttagttacttaccgttaacaacggttacgggacacgtccgtaggacggtacgtaccggtaggaacggacgtaccgggttactttaacgttacgttacggttaggggtacggggtacggtaagggtacggaacgggttaaggttacgggtaaacgggtttacgggggttcgggtacgggggtacccggtagggggtaccccggg

SEQ ID NO: 267124 - DNA, 616 bp, Homo sapiens
  misc_feature: GYAE6OF01BSN1X.28.57.F02.1.454.CMB.1.raw
  modified_base (448)..(448): a, c, t, g, unknown or other
  misc_feature (448)..(448): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggagcttggtccagccgtggggggtccctgagactctcctgtgcagcctctggattcaccttcagtatttatgctatgcactgggtccgccaggctccggagggacggcgtagatagtgtctacgtagtatagtaatagtgacgtaataactataattattatacgtaactaactcgtaggtaggaacggacagtactaccactatcctacggaacggaactactaccgaaagaccacgtntacgtacttctaacaaggtcggacacgtactaggagtacgtacgtacggaagtaccgacggtagttacgttacttaacggttcgtaggggtagggagggtagggaacggtacgggtaagttacgggtaacgggttaggggttacgggtcggggaccgggtaacggggg

SEQ ID NO: 267125 - DNA, 747 bp, Homo sapiens
  misc_feature: GYAE6OF01BUIMY.28.57.F02.1.454.CMB.1.raw
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccnccaggcctccgagggaggactggaatatgtctcaggtattagaagtaatgacgaataacataatattatgactaaactctgtagaagggtcaggtacttaccgaaccctattacgacccgaagggtaaccctaaacgtttcccgaaaacggtaaacctacgtacccttaaggtaaactttcccgttttaacccgaaaaaggtttcggggaccctaaacgggtccccgttaggaaacgggtaacgttccgttaggaaaccgggggtaaccctaacccggggtctttaggtttaatttaaaaccggttttacccggtgggggtttaaaccggggggaaggtaaacccgggggggtagtaaaaccccgggggttaaagttttcgggggaaaaaacccgggtttagggggggtttttacgggtcgggggggtaccccgttaaaaccggggggggg

SEQ ID NO: 267126 - DNA, 746 bp, Homo sapiens
  misc_feature: GYAE6OF01A5ZYK.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctattttaaaggtgtccagtgtgaggtgcgagcgtggtggagtcgtgggggaggtcgttggtccaggccgttggggggtccctaggacgtacttctccgtgtcgcacggtcctcgtggtacttacctaaccgttctaagttatttagtgtctagtgactacggtcgggtccncgaggccgtaccggaggggtaacggtacgtagtaatagtcgtacgtacgtaaggttaattaagaagtaacgtagaacgtaaaataacgtaattaattagttaacgtacgaactaaacgttcgtaggtaagggaacgtacgtaagtacttaccgaaaccgtacgtacccgtaaccgtaacgggtaaactaacgttaaccgaaagtaacctcggtaaacttcgttaaactttaccgtacgtaaagccgggtataacggtcgtacggaagtcggtacggtaggaaccggtacgtcgggtactttaggtactttaaacgtcgggtagggtaacggggaggtagggtaaccgggtagttaaacgggttacggggttaaacgggttacggggtttacggggacgggggtactaaccgggggg

SEQ ID NO: 267127 - DNA, 620 bp, Homo sapiens
  misc_feature: GYAE6OF01A1M4I.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtcccgcgaggctccgaggggaagggactggaatagtgtctcgtaggtattagaagtaatgagaataacattaatattatagacaaactcgtggtagaagggcaagtcttaccaaccactcctaaccggaaggtaactaaacgttacccaaagaacctaccggtacccttaattaccttacgaaagtcgggacacgccgtaggacgtagtcgtagacggacctcgggtacttggtaattagttaaccgtgggtaggggagaagggaggtaccggtaagtttacgggaacggttaggggttgggacggggacgtacggggtcccg

SEQ ID NO: 267128 - DNA, 769 bp, Homo sapiens
  misc_feature: GYAE6OF01ARYEE.28.57.F02.1.454.CMB.1.raw
tcagagtacgctatcacgaccggtgctcgatttagctcgatatagttgggtctggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagtcttggtccagtccggtggggggtccctgacgacttctccgtgtgcgacgtccttcgtggtactttccctaacctttcaagtttactttagtcgtaccttatcgacctacggttccgggtccccgccgacggtccgtacccggaagggggaacgggtaccgtaggaaacttagtacgtacgtacgtaaggttaagttaagtaaagttaagtacggaacgtaaaactaactaattaagttacttaacgtacgtaactaaacttcgttaggtaaggaaacgggtctaaggttacttaccacctaacgttccgtaccgaaacggtaactaacgttaaccgaaacgtaccacgtctagttaccttacttaacgaacgtcggactacgtaccgtagacgtacgtacgtagaaccggtacgtaacggtcttaacgttagtaacggtttacggttagggaagggtaacgggtagggaaaccgggttaacggttaaacggtttaacggggttaacgggtttaaggggggttcggtaaccggggggtaccggtaaaccgggggg

SEQ ID NO: 267129 - DNA, 784 bp, Homo sapiens
  misc_feature: GYAE6OF01CL0F4.28.57.F02.1.454.CMB.1.raw
  modified_base (206)..(206): a, c, t, g, unknown or other
  misc_feature (206)..(206): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctgggtggagtcgngggggaggcgttggtccaggccgtggggggtccctgagactctcctgtgcacgcctcgtggacttcaccttcagttatttagtgtctatgctacgtcggggtcccgaccgagggcctccggaaggggaacgggtacgtagggtaaattagttcgtcgttacgtaagggttacgtttaaaggtaaacgttaagttacggaaacggtaaaacttaaacgtaaattaatttaagtttagtacgtaacctaaaaccgtttcgttaggttaagggaaacggggtactaagtaacgtttacccaaccctaaccgtttccgtaacccgggaacgggaaccttaacgttaacccgaaaggtaaacccacggtacttacgttactttacccgtttaacgaacggttacggggactaacggtacccgtaaggacgggtaagcccggttaggaacgggtacgtaaccgggtacgttagttaaacgttacgttaacgttcggggtaggaacgggtacgggaacggtagggtaaacggtttacgggttaaacggttaggggttttcggggacggggtccggtaaacggggg

SEQ ID NO: 267130 - DNA, 775 bp, Homo sapiens
  misc_feature: GYAE6OF01BHT79.28.57.F02.1.454.CMB.1.raw
  modified_base (758)..(758): a, c, t, g, unknown or other
  misc_feature (758)..(758): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagtcttgggttttccttgttgtcttaatttttaaaggtgtccagtgtgaggtgcagcgtggtggagtcggtgggggagtcgttgggtccaggtccggtggggggtccctggacgtactctcctgtcgcacgtcctcgtggtactttccacctttcgtaagttatttagtgtaccttagtcgccgtacgtcggggtcccgaccgtaggtcctaccggaaggggaacgggtacgtaggtaacttagtcggtacgtacgtaaggttaaattaaggtaaagttaagttacggaaccgtaaaattaaacgtaaatttaattaaagttagtacgtaacctaaaacttcgtaaggttaggaaacgggtctaagtactttaccgaactacgttacccgtaaccgtaacgggtaaacctaacgttaacccgaaaaggtaaccgtaaccggtcttaacggttaaccttaccgtttaacgaaacggttcgggaactaacggtaccgtaggaacgacgtaccggtaggaaccggtaccgaggtacgttagttaacgtaagttacggtagggtagggaaggtacgggaggtaacggtaagttacgggaaacgggtttggggtacgggnggggtaccggtaacggg

SEQ ID NO: 267131 - DNA, 673 bp, Homo sapiens
  misc_feature: GYAE6OF01BIJMD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcgttggtccagccgtggggggtccctgagactctcctgtgcagcctcgtggacttcaccttcagttatttatgtactatgcacgtcgggtcccgccgaggtcctaccgaggggaaggacgtaggaatagtgtacctagaggttaattaagaagtatagacgaaataacagtaattattactgaactaaactcgtagtagaaaggacagtacttccaactactctaccgaaaggtaacctaagttacccaaagaacctacgtctagttaactacctaacgtaaagtcgggacaccgtcgtaaggacgacggtcgtaggaacggactacgggacttacgttaacgtaacgtttaggtaggggtaggggaaacggtaagggggacgtaacgggggttaaaatttcgggggaaacgggtttaagggggtttcggggaacgggggacccgggtaaacggggg

SEQ ID NO: 267132 - DNA, 800 bp, Homo sapiens
  misc_feature: GYAE6OF01A9IZ5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggaggcttggtccagccgtgggggtccctgagactctccgtgtgcacgcctcgtggactttccaccttctaagttatttatgtctagtcgtcctacgtcggggtcccgaccgacggtccgtacccggaagggggaaacgggtacgtagggtaattacgttcgtcgtacgtaaggttaagttaaggaaacgttaagtacggaacgtaaaacttaaactaattaattaatttaacgtacgtaacctaaaacgttcgttagggtaacggaaacgggtacgtaacggttaactacccgtaaaccctacgttaccccgtaacccgggaaacgggtaaaccttaaacgttaacccgaaaaccgaacccgtaccgtaccgttagttaaccttccttaaacgtaaggtcgggacacggtaccgtaggacgtacgcgtacggaacggtaccgacgttacgttagttaaacgttaggtttacggtaggggtaagggaacgggtaaacgggtacgggaaaccggggtttaaaggttaaccggggttaaacgggtttaggggggttcggggtaccggggggtacccgggttaaaccggggg

SEQ ID NO: 267133 - DNA, 564 bp, Homo sapiens
  misc_feature: GYAE6OF01A6BMA.28.57.F02.1.454.CMB.1.raw
  modified_base (378)..(378): a, c, t, g, unknown or other
  misc_feature (378)..(378): n is a, c, g, or t
  modified_base (420)..(420): a, c, t, g, unknown or other
  misc_feature (420)..(420): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggagcttggtccagccgtggggggtccctgagactctcctgtgcagcctctggattccaccttcagtatttatgctatgcacgtggtcccgccgaggcctccgagggaaggactggaatatgtctacgaggtattagaagtatgacgaataacatatatatgacaactntgtagaggcagtatcacatctcgaggacaattccaagacacnctagtactcttacaagtcgggacacgcctaggaacgacgcgtaggaacggaccgtacggntacgttattagttacgtggtagggagtagggacggtacggaaggttacgggtaaggttaggggtggtcggggcggtaacggggg

SEQ ID NO: 267134 - DNA, 747 bp, Homo sapiens
  misc_feature: GYAE6OF01CWM4A.28.57.F02.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcngcctctggattccaccttcagttatttangctatgcacgtcgggtccgccgagctccgaggggaacggactggaatatgtctacgaggttaattaaggaaagttaatcggaacgtaaaattaaactaagttaattaagtttaatacggtaacctaaaacgtttcgttaggtaaggaaacggggtactaaggtaactttacccaacccgtaacttcccgttacccggaaaggggtaacctaaacgtttaacccgaaagtaaacccgaacggtaccttacggttaacttacccgtttaaacgaaacggttacggggacctaacggtacccgtagggaaccggtaggtcgttagggaacgggacccgtaccgggtacttaggttacttaacgtttacggtaggggttaggggaaggtaaggggacgggtaacggtaaggtttacgggaaacgggtttgggggttacgggttacgggggcccggtaaacgggggg

SEQ ID NO: 267135 - DNA, 697 bp, Homo sapiens
  misc_feature: GYAE6OF01DI6AT.28.57.F02.1.454.CMB.1.raw
  modified_base (682)..(682): a, c, t, g, unknown or other
  misc_feature (682)..(682): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttgctattttaagtgtcagtgtgaggtgcagcgtggtggagtcgtgggggagcttgggtccagccgtcggggggtccctgacgactctccgtgcagccgtctggattctaccttacctagttattatagtctattgctacgtcgggttccggcccgtacggccgtaccggaggggaaacggggacggtaggaagtaactgttccgttagtaacggttaagtaagtaagtaagtacgacgaaagtaaactaataattaattaatcgtaacaaacttacgtggtaggtaacgggacgtagactttaccaaccattaccgtccaaagggaaccttaattaaccgaaacgtaaccacgtcttacgtaactttctaacgaaaggtaccggacgtacgaacccgtggaaggacgtacgacggtaaggaccccgtaggtacgttacttaagtacgtttaagggtagtagggggtaacgtacgggaggggtaaacgttaggttagggtaacgggttacgggttgggtaaccgggngggaacgggttccgg

SEQ ID NO: 267136 - DNA, 685 bp, Homo sapiens
  misc_feature: GYAE6OF01BUPZ4.28.57.F02.1.454.CMB.1.raw
  modified_base (261)..(261): a, c, t, g, unknown or other
  misc_feature (261)..(261): n is a, c, g, or t
  modified_base (446)..(446): a, c, t, g, unknown or other
  misc_feature (446)..(446): n is a, c, g, or t
  modified_base (525)..(525): a, c, t, g, unknown or other
  misc_feature (525)..(525): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccagccgtggggggtccctggagactctcctgtgcagcctntggtattccacctttcagttatttatgtctatgctacgtcggggtcccgccgaggcctcccggaaggggaacgggactagggaaatagttcgtacctacgtaaggttaattaaggaaaggttaatggaccgaaataaacgtattaactattaatagaactaaaacttcgtaggtaggaaacgggntaagtacttacaaccctatccctaccgagggaaacctaacttacccgaaagtaaccacgtactagttactaccgttaanaaacggtcgggactacgtccgttaggacggtacgacgttacggaacggtaccgaacggtcgttagttaattacggttagtcggtaggggaaggagggacggtaacggtaaaggttacgggtaaacggttaggggtcgggtacggggaccggtaacggggg

SEQ ID NO: 267137 - DNA, 544 bp, Homo sapiens
  misc_feature: GYAE6OF01AZGCF.28.57.F02.1.454.CMB.1.raw
  modified_base (368)..(368): a, c, t, g, unknown or other
  misc_feature (368)..(368): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagttatttatgctatgcactgggtcccgccaggctccgagggaagggactggaatatgtctcaggtattagaagtatgacgaataacatatattangactaaactctagtgaaggcagatcaccatcctccagggacaacttaccaagaccacgtctgtatctacaagtgggacagcctgagagcgtagacggacacggctgtatattacgtggtagggaggagggagacggtaagttagggtaacgtaggggttgggtggggcgtacgggg

SEQ ID NO: 267138 - DNA, 782 bp, Homo sapiens
  misc_feature: GYAE6OF01DP0OQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagtcgttggtccgagccgtgggggtccctggagctctcctggtgcacgcctcgtggtacttccaccttctagttatttatgacttatcgacctacgtcggggtccctcgacggtcctaccggaaggggaacggtacgtaggtaaactagttcgttctacgtaaggttaattaaggtaaagtagtaggaaccgtaaaattaactaagttaatttaaagttacgtacgtaactaaacgtttgtacggttagggaaacggtacctaaggtacctttaccaaccctacgttacccgtaaccggtaacggtaaaccttaaaccgttacccgaaaacgtaaccgacgtacgttacgttactttaccttaaacggaacgtcgggaacctacgtaccgaggtaacggtacgtacggtaacggaacggtccgtaaacggttcgttaagtttacgttaacggtttaccggtggggtaaacggggaagggtacgggtaaacggggtaacggttaaggttaacgggttaaccggggttagggggtttacgggtaccgggggtaccgggtaaacccgggggg

SEQ ID NO: 267139 - DNA, 794 bp, Homo sapiens
  misc_feature: GYAE6OF01COZVA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagtcgttgggttttccttgttgtcttaagtttttaaaggtgtccagtgtgaggtgcagcgtggtggagtcgtgggggagtcgttggtccaggccgtggggggtccctggacgtactctccgtgtgcacgtcctcgtggtacttccaaccttcaagttatttatgtctatgctacgtcgggcccgtccgacggtcctaccggaaggggtaacggtacgtagggtaaatagtcgttacgtacgtaaggttagttaaaggaagttaacgtggaacgtaaaataacgtaattaattaattaagtacgtaacctaaacgttcgtaggtaggtaaacgggactaagtacttaccgaaccctacgttacccgtaaccggaaacgggtaaacctaacgttaaacccgaaacggtaaccctaaccggtacttacggttaaacttacccttaaacgaaacggtcggggacctaacgggtaccgtaaggaggtaccggacgttacgggaaacggtcccgaaccgggtcttaagttaaacgtttacgtttaaccggtggggtaacgggggaaagacgggggtacgggttaaacggttaaacgggtttaacgggtaaaccgggtttaggggttaccggggtaaccgggggccggtaaaccgggggg

SEQ ID NO: 267140 - DNA, 628 bp, Homo sapiens
  misc_feature: GYAE6OF01ARAAK.28.57.F02.1.454.CMB.1.raw
  modified_base (424)..(424): a, c, t, g, unknown or other
  misc_feature (424)..(424): n is a, c, g, or t
tcagagtacgctatcacgaccggtgctcgatttagctcgatatagttgggtctgggagaggagcccccgccctgggtttcccaggtgttctcatttggtgatcagcactcgcacacagaagagtcatgacggagtttgggctgagctgggttttccttgttgctatttttaaaggtgtccagtgtgaggtgcagctggtggagtcgtgggggagcgttggtccagccgtgggggtccctggagactctcctgtgcagcctctggattccaccttcagttacttatgctatcgctacgtcggtccgccgtaggcctccgaggggaacggctaggaatagtgtctacgaggttataagaagtatgacgtaaataacatataattatgacaaacctgtacgtagaacggcaagtataccgacctacnccgtacgaggaactacgtaccaacgtaaccgacgtcttagtaacttccgttaagaacgtcgggaccagtacccgttagaacggtacgcgttaggacggacacggtgtaacgtaacgttacgttacggtggtaggggaggtacggaacgggtacggtaacggttagggtaacccggttagggtcgggacgggtccggtaacgggg

SEQ ID NO: 267141 - DNA, 815 bp, Homo sapiens
  misc_feature: GYAE6OF01ECCLD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttcccttgttgcttagtttttaaaggtgtccagttgtgtaggtgcagctggtggagtcgtgggggagtcgttggtccaggccgtgggggtccctgacgactccgtccgtgtcgcacgccttcgtggtacttccgacctttcgaagttatttatcgtactatgaccagttcgggtcccgcgacggtcctaccggaggggaacggtccgtaggaagttcgtacgtacctacgtaaggttaattaaggtaaacgttaagttacgaacgtaaaataaaccgtaagttaactttaactttaagtacggtaacctaaaccgttcgttacggtaagggaacggtacgtagtaactttaccaaccgtaacgttccgtaccggaacggtaacctaacggtttaccgaaacgtaaccgtacgtacgttacgttaacgttaccgtttaacggtaaaggtttaccgggactaccgtcccggttaacggaacggtaccgtaacggttaacgggaaccggacccggttacgggttacccgtttaaggttaaacctttaccggtttaccggtagggttacggggaaggtaaccggggaacggttaacgggtaaacggtttcgggaaaaacggggtttggggttaaacggggtcgggggtaaccccggaaccgggggg

SEQ ID NO: 267142 - DNA, 685 bp, Homo sapiens
  misc_feature: GYAE6OF01A1NP0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagttatttatgctatcgctacgtgggtcccgccgaggcctaccgaggggaacgggacgtagggaattagtgtctacgtaggtattaagtaagtaagtgacgtaaataaacaattaattaatttaatgtactaaactcttaggtagaagggcagtacttcaacctatcctacgacggtaactaacgttacccaaacgaaccaaccgtcttacggttaacttccgtttaacaaaggtcggggacctaacggaccctaggacgtacgtaccgtaggaacgggacgaaccgggtcgtacgttataacgtttacggtggggttaggggaaggtaaggggaaggtaacgggttaaaggttaacggggtaaacggttaggggggtttagggtaccggggggtccggtaaaccgggggg

SEQ ID NO: 267143 - DNA, 574 bp, Homo sapiens
  misc_feature: GYAE6OF01DKFN9.28.57.F02.1.454.CMB.1.raw
  modified_base (556)..(556): a, c, t, g, unknown or other
  misc_feature (556)..(556): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatcgcacgtcgggtccgccgaggcctccgaaggggaaggactggaatatgtctcgaggtaattagaagtaatgacgaaataacataatattatgacaactctggtagaagggcagattcacatcacgaggactaataccaaagacacgctagtatcttaacaagtgggacagcctagagagcgtaggacggacacggtctagtattagttacggtggtaggggagagggacggtacggtaaagtttacgggaaacggttggggttcgggngggggaccgtaacggggg

SEQ ID NO: 267144 - DNA, 780 bp, Homo sapiens
  misc_feature: GYAE6OF01CAE66.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctgtggtattcaccttcagttatttatgtctatgcacgtcgggtcccgccgaggtccgtaccggaaggggaacgggaccgtaggtaaagttacgtcggttactacgtaaggttaatttaaaggtaaagttaacgtaggaacgtaaaattaaacgtaattaattaatttaactacggtaactaaaaccgttcgttacggtaggaaacggggacaaggttacttacccgaaactaacgttcccctaaccgggaacgggtaaaccttaaacttaaccggaaacgaaccctaaccggttcttaacggttactttaccgttaaacgttaaacgggttacgggacctaaccgggtacctagggaacggtaccgtacggttaacgggaacgggtaaccgacggttaccgttagttaaacttagtttaaacggtcggggtaagggggaaggtaaggggtaccggaagggttaaacggtttacgggaaacgggtttagggggttcggggtaccggggcgggtaaaccggggg

SEQ ID NO: 267145 - DNA, 753 bp, Homo sapiens
  misc_feature: GYAE6OF01BMQIJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgacgactctcctgtgcagcctgtggattccaccttcagttatttatgctatgcctacgtcgggtcccgccgaggtcctaccggaagggggaacgggacgtagggaaattagtcggtactacgtaaggttaatttaaggaaagttaagtagtaacgtaaaattaaactatttaattaagtttagtacgtaaccttaaaaccgttcgttaggtaagggaaacggggtactaacggtactttacccgaacccgtagttaccccgtaacccggaacggggtaaaccttaaacgttaaccccgaaaacggtaacctaaccggttcttacgttaactttacctttaacgaaacggttcgggtaccaacggtcccgtaggacgggtacgtcggtaggaacggaccgtacggtcttaggttaattacggtttacgtggggtagggaaggtagggaacggttacggggtaaattacgggggaaaggtttagggggtttcgggcgggggtaacccggtacggggg

SEQ ID NO: 267146 - DNA, 858 bp, Homo sapiens
  misc_feature: GYAE6OF01D0XG5.28.57.F02.1.454.CMB.1.raw
  modified_base (178)..(178): a, c, t, g, unknown or other
  misc_feature (178)..(178): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtntccagtgtgaggtgcagcgtggtggagtcggtagggggaggcttggtccaggtcccggtggggggtcccctggaagtcctctccgtgtcgcacgccttcgtaggtacttccaaccctttcgaagttattttaatgtctaagtcgactacgttcgggggtcccgaccgacgggaccttacccgggaaggggggtaacggggtaccttaggggtaaacttacggttacgttacccgttaacggtaaagggttaacgttaaaaggtaaaagttaaagttacggaaaccggtaaaactaaaacctaaatttaacttaaagtttaacgtacggaaacctaaaaccgttcgtaacggttaaggaaacggggtactagtaaccgttacccgaacctacgttcccgttaaccgacgggttaaacctaacgttaaccaaacgaaccgtaccggtacttacgttaacgttccgtttaacgtaaacggtcgggtaactaaccggtacccgtaggtaacggtacgtaccggttacgggaacggtacccgtaacgggttaccttaagggttacttaaggtttacgggtacggggtaaggggacggtaaacggggacggtaacgggttaaacggttacggggtaaaccgggtttagggggttaaggggtcccggggtaacgggtaacccggggg

SEQ ID NO: 267147 - DNA, 125 bp, Homo sapiens
  misc_feature: GYAE6OF01CREDM.28.57.F02.1.454.CMB.1.raw
  modified_base (118)..(125): a, c, t, g, unknown or other
  misc_feature (118)..(125): n is a, c, g, or t
tcagagtacgctatcacgaccggtgctcgatttagctcgatatagttgggtctgggagaggacgcccccgccctgggttcccaggtgttctcatttggtgatcagcactgcacacaannnnnnnn

SEQ ID NO: 267148 - DNA, 899 bp, Homo sapiens
  misc_feature: GYAE6OF01EH326.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttagtttttaaaggtgtccagtgtgaggtgcagctggtggagtcgtgggggagtcgttggtccaggccgtgggggtcccctgacgactcctcctgtgcacgccttcgtggtacttcctacctttcgtagtttattttagtgtactatcgctaccggttcgggtcccgccgaggtccgtacccgggaagggggaacgggtacgtaggtaaacgttagttacgttccgttaacgtaagggtttaacgtttaaaggtaaacgttaaagtacggtaaacgtaaaacttaaaacgtaatttaaagtttaagtttaacgttacggtaaccttaaaaccgtttccgttagggtaaacgggtaaacgggtactaacgttaacctttacccgaacccgtacttacccgtaacccgggtaaaggtaaacccgttaaaccgtttaccgaaaaacggtaacccgttaaccggttacgtttaaccgtttacttaacccgtttaacgtaaacgggttccgggaacgttaaccggaccgttaagggacggtaacggtacgggtaacggaacggggtacccggtaacgggttaccgttaaggtttaaacgtttaacgtttacggggtaggggttaaccggggaggggttaaacggggaaccgggttaacgggtaaacgggttttacgggtaaaacgggggtttttagggggtttcggggtaacccggggggtccgggtaaacccgggggg

SEQ ID NO: 267149 - DNA, 740 bp, Homo sapiens
  misc_feature: GYAE6OF01EJB0B.28.57.F02.1.454.CMB.1.raw
  modified_base (440)..(440): a, c, t, g, unknown or other
  misc_feature (440)..(440): n is a, c, g, or t
  modified_base (464)..(464): a, c, t, g, unknown or other
  misc_feature (464)..(464): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttattttaaaggtgtccagtgtgaggtgcagcgtggtggagtcggtgggggaggtcgttggtccaggcccggttcggggggtccctggacgtacctccgtccgtggtgccgacggtcctcgtggtacttcctacccgttctagttaacttttagtgtcttagtcgacctacggtcggggtcccgccgacgggtcctaccgggaaggggaagggtactaggaattgtcgtactacgtaggttaagtagaaagtaatagagtaaataacatatattanagaactaactcgtagtaggagganagtactaccacgtactccgtacggaacggaactaacgtaccgaaagtaaccacgtctacgttactacgttaacaaggtcggactacgacccgtagaacgtacgtacgtaggaaccgggtaccgtaccggtatttaacggttaaagtttaacgttacgggttacggggaacgggggtaaggtaacggggaaggttaaccgggttaaaggtttaacgggggtaaacggtttaaggggggtttcgggggtcccgggggtaacgggtaaaccccgggggg

SEQ ID NO: 267150 - DNA, 743 bp, Homo sapiens
  misc_feature: GYAE6OF01ACE6L.28.57.F02.1.454.CMB.1.raw
  modified_base (598)..(598): a, c, t, g, unknown or other
  misc_feature (598)..(598): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttaatttttaaaggtgtcctagtgtgaggtgcagctggtggagtcgtgggggagcgttggtccaggccgtggggggtccctggagcctctccgtgtgcacgtcctcgtggtacttcctaccttcgtaagttattttatcgtacttatgccgtaccgtcggggtccccgaccgacggtcctaccgggaaggggtaaacggggcttaagggaaattgttcgtacctacggtaaggttagttaaaggaaacgttaacgtacggtaaccgtaaaattaaaccgtaatttaactttaaattaacgtacgtaaccctaaacgttcgttaaggtacggaaaggtacaagtacctttacaaccctacgtcgaccggaagtaacctaaacgtacccgtaaaagaccgtacgtcgttataaccttcgtaactaaggtccggganaccggtcctaaggcgtagcgtaggacgacgtacggtatcgttaataccggttgttacggggaggaagggtcggtaaacgggtaagttaacgggttaacggggtaaggttggggggtttacggacccgggggaggttaccccgggg

SEQ ID NO: 267151 - DNA, 670 bp, Homo sapiens
  misc_feature: GYAE6OF01DHJWG.28.57.F02.1.454.CMB.1.raw
  modified_base (389)..(389): a, c, t, g, unknown or other
  misc_feature (389)..(389): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttatttttaaaggtgtccagtgtgaggtgcagctgggtggagtcgtggggggagcttggtccagccgtggggggtccctgagactctcctgtgcacgcctcgtggtattctaccttcaagttatttatgactagtcacgtacggtcgggtcccgcgacggtcctaccgggaaggggacggtacgtaggtaatagtgtacacggtaagttagttaaggaaagttanacggataaactaactaattattaattagtacgaactaaactcgttaggaagggtaacggacagtactccacctactcgtacgacggtaacactacaacgacacgtctatactactaanaggtcganacgacgtagacgtagacgacggtacgaccggtacgtacgttagttacgttaagttacggtaggggtagggtaagggtagggaacgggttaaccgggtaaagttaggggtaaacggttttagggggtaacgggtcgggggacgggtaaacccgggg

SEQ ID NO: 267152 - DNA, 609 bp, Homo sapiens
  misc_feature: GYAE6OF01DQZXW.28.57.F02.1.454.CMB.1.raw
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccaggccgtggggggtccctgagactctcctgtgcagcctcgtggattccaccttcagttatttatgctatgcacgtcgggtcccgccaggcctaccgagggaacggactaggaatagtgtctcgaggtatagaagtatgacgaaataacatatattangacaaactctagtagaaggcagtattaccacattccaccgaaggactaacttaccaaagaaccacgtcttagtacttaccttacgaaagttcgggacaagcccgttagagacgcgtaggaacggacacggtcttagtacttaagttacgttgggaggggtagaacgggaggtacggttaaacgttgggaaacgggtttggggttagggtacgggggtcgaaacggggg

SEQ ID NO: 267153 - DNA, 659 bp, Homo sapiens
  misc_feature: GYAE6OF01ECR79.28.57.F02.1.454.CMB.1.raw
  modified_base (534)..(534): a, c, t, g, unknown or other
  misc_feature (534)..(534): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggaggtcgttggtccgaggccgttcggggggtcccctggagacctctccgtgtcgcacgcctctggtacttccaccttcagttattttatgctatgcacgtgggtcccgccaggctccggagggaggactggaatatgtctcgaaggttattaagaagtatgacgaataactatatattatgaacaaactctaggtaggaaggcagtatcaccatctaccgaggaactaacttaccaaagaccacgtctagtattacgttacaaagttcggaacgtacgtacccttaggacgtaggtaccttagggacggacgaccggttnttaacgggttacttaacgttttacggtagggttacggggaaggtaagggaacgggtaacgggtaaaggtttacgggtaaaccgggtttagggggtttacggggtccgggggaccggtaacggggg

SEQ ID NO: 267154 - DNA, 684 bp, Homo sapiens
  misc_feature: GYAE6OF01EBNKB.28.57.F02.1.454.CMB.1.raw
  modified_base (265)..(265): a, c, t, g, unknown or other
  misc_feature (265)..(265): n is a, c, g, or t
  modified_base (664)..(664): a, c, t, g, unknown or other
  misc_feature (664)..(664): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcgttggtccaggccgtggggggtcccctgagacctctcctgtgcagcctntggattcaccttcagttatttatgcttatcgctacgttcgggtcccgccgacggcctaccggaggggaacgggacgtagggaatagttcgttcctacgaaggtttaagtaaggtaagtaagtgaacgtaaataaactattaattattaatagactaaactcgtaggtaggaaggacagttacttaccaacctatcctaccgaagggtaacctaaacgttaccgaaacgtaaccgacgtaccttagtacttaccgttaagtaaagtcgggtactaacgtcctaggaagcgtactacgggaacggacgtacgggtacttacggttaattagttacggtaggtacggggaaggtagggaacggtaggttaaagtacgggttaaacggttggggtttacgggnggggtaaccggtaacggggg

SEQ ID NO: 267155 - DNA, 721 bp, Homo sapiens
  misc_feature: GYAE6OF01BEHB2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcacgcctcgtggacttcaccttcagttatttatgctatgcacgtgggtcccgccgaggcctaccggaggggaagggacgtaggaactagtgtctacgtaggttattaagaagtaatagacgtaaataactattataatttactagactaaaacgtcgtaggtaggaaggggacaaggtacttaccaacctactaccgtaccgaacgggaactaacttaaccgaaacggaaaccaaccgtacgttagtaacttaccgttaacgtaaaggtcgggtacaacggtaccgtaggaacggtacggtcgtaagggaacgggaccgaaccgggtcgttacggttaattaaacgttacggttggggttacgggggaagggtaacggggaagggtaacgggttaaagggttaacggggttaaacgggttacggggggtttagggggtaccggggggtaccgggtaaaccggggggg

SEQ ID NO: 267156 - DNA, 624 bp, Homo sapiens
  misc_feature: GYAE6OF01AUCJ8.28.57.F02.1.454.CMB.1.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgttcgtgtaggcctattaaagtgcagtgtgagtgcagctggtggagtcgtgggggaggtcttggtcccaggcccgtggggggtaccctggacactctcctgtcgcactcctcgtaggacttacnccttcgatattactgctatgcttacncggggtccnccgaggtcctccgaagggaaggctggaatntcggantaaggtnaggtaatagtagactaaataacatatacgttaancacgtaactagtgtaggtaggtacgtacgtactactactactacgtacgtaacgtaactaactaacgtaacgaacgtaacgtacgtacgtacgtactaacgtaacgtacggtacgtacgtacgtagacgtacgtacgtacggaacgtacgtacgtacgtagtactacgttacgtaggtagggacggtaggtaggtaggtaggttacggtaacggtaggttacgggtcgggtacggtacgg

SEQ ID NO: 267157 - DNA, 718 bp, Homo sapiens
  misc_feature: GYAE6OF01CKJT3.28.57.F02.1.454.CMB.1.raw
  modified_base (286)..(286): a, c, t, g, unknown or other
  misc_feature (286)..(286): n is a, c, g, or t
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtaggtttgggctgagcttgggttttccttgttgcttaagtttttaaaggtgtccagtgtgaggtgcagcgtggtggagtcgtgggggaggtcgttggtccgagccgtggggggtccctgagactctccgtgtgcagcctctggtacttcaccttnagttatttatgacttagtgcacgtcgggtcccgccgaggcctaccggaaggggaacggactagggaaattacgtgtccgtagtaaggttaattaaggaaagttaagaggaacgtaaaataaacattaataattagtagactaaaacctgtagtaggaagggactagtattccacatcctacgaaggaactaacttaccaaagaaccacgtactagtactacttaanaaacggttcgggacacggtacctaggaaggtacggacgttaggaacgggaacccgtaacgggcgtttaagtaacgtttaacgtttaaccggtggggttaaggggaaggaaggggtaacgggtaccggggttaaaaggttacgggggtaaaaccgggttttaggggggtttaccggggtacgggggggtaacccggtaaacgggggg

SEQ ID NO: 267158 - DNA, 888 bp, Homo sapiens
  misc_feature: GYAE6OF01EELMQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtacttaagtttttaaaggtgtccagtgtgaggtgcagcgtgggtggagtcggtgggggaggtcgttcggtccgaggtcccggttcgggggggtcccctggacgtaccttccgtccgtggtcgcacgtcccttcgtggtacttcctacctttacgtagttattttagtcgtaccttaagtcgccgtaccggttcggggtccccgaccggtacgggtacccgtaccgggaagggggtaaacggggtaccgtaagggtaaacttagttcggttaccttaacgggtaagggtttaaacgttaaggtaaaaggttaaagtacggtaaaccgtaaaagttaaaccgtaaatttaatttaaacgtttaacgttaacgtaaaccttaaaaccgttcgttaaggtaacgggtaaacgggtacctaaacggtttaccttaaccctaaacccgttacgttaccccgtaaccggtaacgggtaaaaaccttaacccggtttaaacccggaaaaacgtaacccgttaacggttacgtttaaggtttaaccttaaccggttaaacgtaaacggggtccgggtaacgtaaccggtccggttaaggaacgtacggtacgtaagggaacgaccggtaccggttagttacgttaagtaggttacggtggggttaacgggaggttaacgggaggttaacgtagggtaggttaacgggtgggttacggcgggacggtacggg

SEQ ID NO: 267159 - DNA, 896 bp, Homo sapiens
  misc_feature: GYAE6OF01DAZ1Y.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagtcgttgggtttttccttgttgtactttaagtttttaaaggtgttcctaggttgtggaggtgctagcgttgggtggaggtcggtgggggaggtcgttcgggtccgacggtcccgggttcggggggttcccctaggacgtaccttccgtccgtgtcgccgacgtccgttcgtggtactttccgtaccttttcgaaggttttatttacgtcggtacttagtacggccgtaacggttccggggttcccgacccggaagggttcccgtaacccgggtaagggggtaaaaccgggtacgttacgggtaaaacgttcggttacgtttaccgtaacggtaaaggtttaaaccgtttaaagggtaaacggttaagttacggaaacgtttaaaaacttaaactaagtttaacgtttaaacgttttacgtaaccggtaaaccttaaaacgtttcgtaacggtaagggtaaacggtacgtaacgttacgttaccaccgttacgtacccgtaaccggtaacggtaacctaacgttaaccgaaagtaacccgtacgttcgttacgttacttaaccgttaagtaaacggtcgggaccgtaacggtccggtaaggaacgtcgtacgtacggtaacgggaaccgtacggttaccgtagttaacgttacgttacggtagggtagggaagggtaacgggtagtacggggttaacggttaacgggtacggttacgggggttaccgggtggggtaacccggtaaccggggg

SEQ ID NO: 267160 - DNA, 846 bp, Homo sapiens
  misc_feature: GYAE6OF01AU76E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggagcttggtccagccgtggggggtccctgagactctcctgtgcagcctctggattccgacctttcagttatttatgctagtgactacgtcgggtcccgccgaggcctaccggaaggggaacgggtctaggggtaattacgttcgtccgttacgtaacgggttaatttaacggaaagttaaagtacggaacggtaaaataaaccgtaagttaattaagtttaacgtacgaaccttaaaaccgttcgttagggtaaggtaaacgggggtctaaacgggttactttaaccccaaccgtaacgttaccccgtaacccggtaaaacggggtaaccttaaaccgtttaacccgaaaaccgggtaacccgtaaccggttaccgttacgttaaccgtttaaccgtttaaccggaaacggtttccggggaacccgttacgggtaccccgttaagggtaaccggtaacggttaccggtacggaacgggtacccggtaaccgggttacgttacggtttaaacgttaacggtttaaccgggtcggggttaggggtaacgggtaacggggtacgggtaaacggggttaagtttacggggaaaccgggtttaggggtttaccggggacgggggttaaccggtaaccgggggg

SEQ ID NO: 267161 - DNA, 829 bp, Homo sapiens
  misc_feature: GYAE6OF01CCHI5.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgtcttatttttaaaggtgtccagtgtgaggtgcagctgggtggagtcggtgggggagtcgttggtcccgaggtcccggttgggggggtccctggacgtacctcctccgtgtcgcacgtcctcgtggtacttcctaccctttnaagtttattttagtgtcttatgtacctacggtcggggtcccgaccgaggtcctaccggaggggaacggacgtaggaacttgtcgtcgtagtaaggttaattaaggaaagttaacgtaggaactaaaataaactaattattaaagttataacgaaccttaaaacttccggtaaggttaagggaaacgggtactaagtaacttaccctaacctacgttacccgtaccgtaaacgggtaacctaacttaacccgtaaacgaaccctaaccggtaccttaacggttaactttaccgttaactaaacgggttacgggaaccgtaccgtaccggtacggtacgggtaacgacggtaaggtaacggtaccggaccgggttacgtaaggttaacgtttaagtttaccggttaggggtaagggtaaaggggtaggggttaaaccgggtaacgggtttaaaggtttaacgggggttaaaccggggtttaagggggtttaccgggggtacgggggtaaccgggttaaaccgggggg

SEQ ID NO: 267162 - DNA, 721 bp, Homo sapiens
  misc_feature: GYAE6OF01CT8QP.28.57.F02.1.454.CMB.1.raw
  modified_base (415)..(415): a, c, t, g, unknown or other
  misc_feature (415)..(415): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttaatttttaaaggtcgtcagtgtgaggtgcagctgggtggagtcgtgggggagcgttggtccaggccgtcggggggtccctaggacgactctcctgtgcagcctcgtggtacttccaccttcagttactttatgtctatgactacgtcgggtcccgccgaggtaccgtaccgaggggaacggtactaggaatagtgtactacgtaagtaagttaagaagtaagtgaacgaaataacgaattaataattanacgaactaaacgttcgtaggtaaggaaggactagtacttaccgaacctactaccgtaccgaaggtaacctaacttaacccgaaacgaactaccgtacgttaacgttaacttaccgttaacgtaaacgtcggggaacctaacgtaccgtagggaaacgtggtacgttacgggaaccggacggtaacggtacttaagttaacgttagttacggttagggtagggaacggtaagggaacgggtaaccggttaagggttaacggggttaaacggttgggggttacgggtcggggacccggtaaacggggg

SEQ ID NO: 267163 - DNA, 650 bp, Homo sapiens
  misc_feature: GYAE6OF01AR5AH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtgggggtccctgagactctcctgtgcagcctcgtggtacttccacctttcgtagttattttagtgtctagtcgctacgtcgggtcccgccgaggcctccggagggaagggctaggaatatgtctacgtaaggttattaagaagtatcgacgtaaataacatatattatacgactaaactgtagtaggaaggtcagtacttaccacctatccgtaaccgtaggtaacctaacgttaccgaaacgaaccacgtacttagtacctttcgtaacgaacgtcgggacctacggtaccgtaggaacggtacgacgtaggaacggacgtacggtacttagttagttaacgtacggtgggtagggaacggaggtaccgggaaggtaacggttaacgggacggttaggggttggtacgggggccgtaacggggg

SEQ ID NO: 267164 - DNA, 625 bp, Homo sapiens
  misc_feature: GYAE6OF01AGNSH.28.57.F02.1.454.CMB.1.raw
  modified_base (351)..(351): a, c, t, g, unknown or other
  misc_feature (351)..(351): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccgccaggctccgagggaaggactaggaatatgtctcgaggtattagaagtangacgaataacatatattatgactaaactctaggtagaagggcagtacttaccacctacttcaccgaagggaacctaacgttaccaaagaaccgtacgtacttagtacttacttacaaagtcgggacacgtccgtaggaacgacgtcgtacggacggaccgacgggtacttagtaaacgttacgttaccggtaggggtaggggaaggacgggaacggtacggtaaaggttacgggaacggttagggggttcgggtcgggggaccggtaacggggg

SEQ ID NO: 267165 - DNA, 581 bp, Homo sapiens
  misc_feature: GYAE6OF01C71GY.28.57.F02.1.454.CMB.1.raw
  modified_base (261)..(261): a, c, t, g, unknown or other
  misc_feature (261)..(261): n is a, c, g, or t
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggaggcttggtccagccgtggggggtccctgagactctcctgtgcagcctcnggattcaccttcagttatttatgctatcgcacgtgggtccgccgaggctccgagggaacggactggaatgtgtactacgaggtattaagaagtaatggacgaaataaacattaatattanagacaacttctgtagaagggcagtattaccactactctaccgaggacaattaccaagaacacgacttagtataccttacgaaagtcgggactacgccgtagacgacgcgtaggaacggacgaccggtctagtattagtacgtggagggaggaggagtagtaagtaggtaacgttagggttacggtgggaccggtacgggg

SEQ ID NO: 267166 - DNA, 678 bp, Homo sapiens
  misc_feature: GYAE6OF01CISH1.28.57.F02.1.454.CMB.1.raw
  modified_base (186)..(186): a, c, t, g, unknown or other
  misc_feature (186)..(186): n is a, c, g, or t
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (601)..(601): a, c, t, g, unknown or other
  misc_feature (601)..(601): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgtggtttctgtgctatttaagtgtcagtgtgaggtgcagntggtggagtcgtgggggagtcgttggccngtccgtgggggtcctgagctctcgtgtgcagcctcgtggacttcctaccgttntagttattatcgcttatcgcgtacgtcgggttcccgccgacggtccgtaccggaaggggaaggtacgtagggtaaatagtcgtccgtaggtaaggttaagtttaaggaaaagttaacgtagaacctaaataaactattaattaatttaggactaactaacctgttaggaggaaaggcctaagtacttccaactattcccgaccgaggaaaccttaaccgtacgaaacgtaccaacgtcgtaacgttactacttagaagtcggacacgaccgtaggagtacgtaccttagggaacgtacgtccgggtaagttaggttaaacttacgtttacggngggtagggtaacgggaggaaccggttaggttaacgtagggtaaccggttgggttcgggaacggggccgtaaccgggg

SEQ ID NO: 267167 - DNA, 722 bp, Homo sapiens
  misc_feature: GYAE6OF01EGC0B.28.57.F02.1.454.CMB.1.raw
  modified_base (287)..(287): a, c, t, g, unknown or other
  misc_feature (287)..(287): n is a, c, g, or t
  modified_base (386)..(386): a, c, t, g, unknown or other
  misc_feature (386)..(386): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggagtcgttggtccagccgtgggggtccctgagactctcctgtgcagcctgtgtacttcacttcagtactttangtctatgctacgtcgggtcccgccgaggcctaccggaaggggaacggagtacggaatagtcgtctagtaaggttaataagaagtatgaagtaaactaanagttaatagttaatacgaacaaacttcgtaggtaacggaaacggtctagtaacttccaacctactccgtaaccggaaggtaaacctaaacttaacccgaaaacgtaaccgtaccgtacttacgttacttacgttaaacgaaagtcgggactaaccggtntaacggaacgtagtacggtacgaacgggtaaccgtacggttaccgttaagttaacgttaagtttaccggtaggggttaacggggaagggtaagggtaacgggtaaccggttaaagggtttaacgggaaccgggtttaggggggttttacggaccgggggggtaccgtaaaccggggg

SEQ ID NO: 267168 - DNA, 943 bp, Homo sapiens
  misc_feature: GYAE6OF01EAY56.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggagcgttggtccagccggtcggggggtccctggacgactctcctgtcgcacgtcctcgtggtacttcctaccttctagttatttagtgtacttagtcgaccgtacggttccggggtccccaccggtaacgggtccgtaccgggaacgggggtaacggggtaccgttaaggggtaaattacggttcggttcccgttaacggttaagggtttaaactttaaagggaaaagtttaacgtacggaaaccgttaaaaattaaacgtaatttaaactttaagtttaaacgtacggtaaaccttaaaaaccgttcgttaagggtaacggaaacggggtctaaacggttaccttaaccgtaaccctagttacccgtaaccgggtaaacgggtaaaccttaaaccgttaaccggaaaacgtaacccgtaacccggttacgttaaccggtttaacttaacccgtttaaacggtaaacggttacccgggaactacccggtaccgttaacggacgggtaaccggttacggtaacggggaccggtaacccggtaccgggttaacgttaacggtttaactttaaacggtttacgggtacggggttaaggggggtaaagggttaaacgggggaaaccggggtttaaaccggggtaaaagggtttacccggggggttaaaacggggttttacggggggttttacgggggtaaacccggggggtacccggggttaaacccgggggg

SEQ ID NO: 267169 - DNA, 884 bp, Homo sapiens
  misc_feature: GYAE6OF01CJ2P8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtgggggtccctgagactctcctgtgcacgcctcgtggtacttcctaccttctagttattttatgtctatcgtcctacgtcgggcccgtccgacggccgtaccgaaggggaacgggtacgtaggtaaattatcggttaccgtacgtaaggttaacgtttaaaggtaaagttaaagtcgtaaaccgtaaaacttaaaacgtaaatttaattaatttaagtaacgtaaaccgtaaaaccgtttaccgttagggtaacgggtaaacgggtaaccgtaacgttaacgttacccccaaacccgttaccttaccccggttaaaccccgggaaaacggggttaaaccctaaaaacgtttaccccgaaaaacggtaaccccgtaaccggttaccgtttaaccggttaacttttaccccgtttaaacgtaaaacgggttccgggaacttaaccggcccgttaagggaacggttaacggtaccgtaagggaaccgggtacgtaaccgggttcttaagggttaacttaaaccgtttacggggttaggggtaagggggtaaacgggtaaggggttacccgggaaagggtttaaacgggtttaacgggggtaaacgggttttaacggggggtttcggggtaaacccggggggtaccgggtaaaccggggg

SEQ ID NO: 267170 - DNA, 1131 bp, Homo sapiens
  misc_feature: GYAE6OF01EM6U6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgacttagtttttaaaggtgtaccaggtgtgaggtgcgagtcgtgggtggaggttcggtgggggacggtcgtttcgggtaccgtacggtcccgggttcgggggggttcccctaggtaacggtacccgttccgttcccggttggttccggaccgtaacggttccccgttggttacggtaactttacccgtaacccttttacgtaaaggttttaattttaagtcgttaccgttaactcggacccgttacggttcccgggggtaccccgaccgggtaccgggttacccggttaccccggggaaaggggggtaaacggggttaaccgttaaggggtaaatttacgtttaccggttaccgtttaacggttaaaggggtttaaacgtttaaaagggtaaaacggtttaaaggacggttaaaaccggtaaaaattaaacttaaagttttaaacgtttaaagttttaacgtaacggtaaacccttaaaacggttacccggtttaaggggtaaacgggaaaccggggtttaactaacgggtttaacctttaaccccaaaccggtttaaccgtttaacccccggtaaccgggtaaaaccgggtaaccttaaaaccgtttaacccggaaaaaccggttaaccccgacggttaacccgttttaccgtttaaaccgtttacggtttaaacccgaaaagggtttccggggaacttaacccgggtaaccgggttaggaaaccgggtcgggttaaacggttaacggggaacccggaacgttaaccggggttatttaaaacggtttaaaggtttaacccgggtttaaaggggttcgggggttaaaggggtaaacgggggtaacggggtaaaaccggggtttaaggggggttttaaaacggttaaccggggggttaaaacgggggtttttaggggggtttaaaacccggggggtccgggggggtaaacccggttaaaaccggggggg

SEQ ID NO: 267171 - DNA, 697 bp, Homo sapiens
  misc_feature: GYAE6OF01AIOZK.28.57.F02.1.454.CMB.1.raw
  modified_base (397)..(397): a, c, t, g, unknown or other
  misc_feature (397)..(397): n is a, c, g, or t
  modified_base (522)..(522): a, c, t, g, unknown or other
  misc_feature (522)..(522): n is a, c, g, or t
tcagagtacgctatcacgaccggtgctcgatttagctcgatatagttgggtctgggaggaggagcccccgccctgggtttcccaggtgttctcatttggtgatcagcactgcacacacgaagagtcatgacggagtttgggctgagcggtggtttcgtgttaggctatttaaagtgtccagtgtgaggtgcagctggtggagtcgtgggggaggcttgggtccaggcccgttgggggggtcccctggacgacctctccgtgttgcacgcctcttggactttcacctttcagttatttatggctagtcgccgtacgtcgggtccgccgagggccttcccgaagggaagggcctagggaatagtgtcctgagggttattagagtaatcgacgtaactanagtactatgtgacgaaacttcttggagtaaggggtcaaggtctttaccgaaccttatcccgtacccgaagggaacctaacgttacccgaaagtacccgacggccttaaggtacttaccgtttaanaaacgttcgggaacctaagtacccgtagacggtaagcgttagggaacggaccaagggttcctaggttaacgttacgttaaccggtggttagggggaaacgtgggtaagggtaccgggaaggttttaacccgggaagggtttacggggtacggttcgggggtcccggtaaacgggg

SEQ ID NO: 267172 - DNA, 737 bp, Homo sapiens
  misc_feature: GYAE6OF01ARI93.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagcgttgggttttccttgttgtcttaagtttttaaaggtcgtccagtgtggaggtgcgagtcgtgggtggagtcggtggggggagtcgttcggtccaggtcccgggttcggggggttcccctggacgtaccttccgtccgtggtcgcctacggtccctcgtaggtacttcctacctttacgtagttatttagtcgtcttagtcgtaccgtaccggttcgggtccccgaccgacggtcccgtaccgggaaggggtaacggtacgtaggtaatcgttcgtctacgtaaggttaattaaaggtaagtaagtacgaacgtaaataactaattaataagttatacgaactaacgtgtaggtaggaacggtactaagtcttacgaaccttctaccgaccggtaacgtaactaacgtaccgaaacgtaccgacgttcttagtaacttacgtaagtaacggtgggaccaagtccgtaagacggtacgacggtaggaacgtacgacggtattagtaacgttagtacggtgggtaagggaggtagggacggtaaggttaggttacgggtaacgggttaggggtccgggcgggacggtaccggg

SEQ ID NO: 267173 - DNA, 865 bp, Homo sapiens
  misc_feature: GYAE6OF01EQMUP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggtgtcagtgtgaggtgcagctggtggaggtcgtgggggaggtcgttcggtccaggtcccggttcgggggggtcccctggacgtaccttcctcccgtggtgccacggtcccttcgtagggtatttccctaacccgtttcgtaagtttattttacgtcgtccttaattcggacctaccggttccgggggttccccgacccgtacggggtccctaccggggaagggggaacggggtaccgtagggtaaacgttaagttccgtaccgttacgtaagggtttaagttaaacgggtaaaagttaaacggtacggtaaaccggtaaaaactaaacgtaaagtttaaacgtttaaagtttaagtaacgtaacctttaaaaaccgtcggttaagggttaaagggtaaaccgggggactaacggttacgtttaacccaaaccccttaacgttaccccgtaaccgggaaacgggttaaccttaaaccgttacccgaaaacggtaacctacggtaccttagttaaccgttaccttaaacgtaaggttccgggacgtacgtacctaggaacgaggtcgtacgggacggtacccgacggtacttaacggttacgttagtttacggtggggtaggtaccggagggtaacggtacggttaaaggttacgggtaacggtttagggggtcgggttacgggaggtaccgggg

SEQ ID NO: 267174 - DNA, 701 bp, Homo sapiens
  misc_feature: GYAE6OF01ERLUC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctcgtggattccaccttcagttatttatgctatgccacgtcgggtcccgtccgacggtcctacccgggaaggggaacggggtacgtaggaattagttcggtctacgtaaggttaagttaaggtaaagttaagtacggaacgtaaaattaaactaattaataagtttaagtacgtaactaaaaccgttcgtaggtaaggaacgggtacagttaacttcccaaccgtatcccgtaaccggaacggtaaactaaccgttaccaaaacgtaacctacgtcttagtacttacgttaacgaaaggtcgggacctacgtaccgtaggtagacgtcgtaaggacggaccgtacggtacgttagtaacgttagttacggtgggtaagggaggagggtaggtacggtaaaggtttcgggaaaggttggggttagggcggggccgtaacggggg

SEQ ID NO: 267175 - DNA, 738 bp, Homo sapiens
  misc_feature: GYAE6OF01CFCXO.28.57.F02.1.454.CMB.1.raw
  modified_base (202)..(202): a, c, t, g, unknown or other
  misc_feature (202)..(202): n is a, c, g, or t
tcagagtacgctatcacgaccggtgctcgatttagctcgatatagttgggtctggggagaggagcccccggcccttgggtttcccaggtgttctctatttggtgatcagcacctgcacacagaacgaggtcatgacggagtttgggctgagcgtggttctcgtagcgtatttaaagtgtcagtgtgacggtgcagctggtgngtcgtggggacgcgttggccacgccggtcggggtccctgacgtacctcgtcctagtcgacacgcctgtcggttactccaccttagtagttaagtttagtaggacttactagtccgtacggttacgggtcccgtaccgacggtacgtaccgggaaggggtaacgggacgtacgggaacttacgtcggtacctacgtaggttaagttaagtaagttaacgttacgtaacgtaaacttaacgttaagttagtacgttaacgtacgaacctaaacgttcgtaggtaacgggaacggtacgacgttaacgtacccgaacgtaagtacccgtacggtaaacggtactaacttaacgaaacgaaccgtcggtacgtacgtacgtaccgtaagaaggtcggactgtacgtagtagtacgtcgtagaccgagtaccggtagttaacttagttacgttacggtcggttagggtaacggttcgggacgtaaacgggttacgtaacgggtcgggtaaagggttccgggtaaaggaaccccgggtaggg

SEQ ID NO: 267176 - DNA, 727 bp, Homo sapiens
  misc_feature: GYAE6OF01B9SYU.28.57.F02.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (323)..(323): a, c, t, g, unknown or other
  misc_feature (323)..(323): n is a, c, g, or t
  modified_base (647)..(647): a, c, t, g, unknown or other
  misc_feature (647)..(647): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtagctatttaagtgcagtgtgagtgcagctggtggagtcgtgggggagtcgttggtccagcgtgggggtcctgagctctctgtgcagcctctggacttctaccttgagttaatttngacttancgctacgtgggtcccgccgaggtccgtccggaaggggaacggngttaggaattatggtacctacgtaagggttaatttaaggaaagttaacgttagaaaccgtaaattaaactagttaattaactttaagactaactaaactttcgtggtaacggaaggtctaagtacttaccaccgttaacgtctacccgaggtaacctaataccaaaggacctcggtacgtacttaacttccgtaagtaagggtacggacctacggttaaccgaggaaccgtagtaaccggtaaggtaacccgggagttacccgggaatttaggggttaaaccttaaacgggtttcggtaggggttaaggggaggttaaacgggngggttaaaccggttaagggttcgggtttaaaacgggggttacggggttgggggttacccggggtaacgggtaacccgggg

SEQ ID NO: 267177 - DNA, 954 bp, Homo sapiens
  misc_feature: GYAE6OF01D8VMV.28.57.F02.1.454.CMB.1.raw
tcagagtacgctatcacgaccggtgctcgatttagctcgatatagttgggtctgggggaggagtccccgccctgggtttcccaggtgttctcatttggtgatcagcactgcacacagaagagtcagtggacggtaggtttgggctgagtcgttgggtttttcctttgtttgtactttaagttttttaaaagggtcgttaccgtaggttggttggtagggttggccgtaggtcgttggggtagggtaggttccgggttagggggggacggttccgttttcgggtcccgacggggtccccgggttcggggggggttcccccttaggaacgttacccgttcccgttcccgttgggtccgccgtacggtccccgttcggttacgggttaccttttccctaacccgtttagtaaggtttttaacttttagtcgtaccttagtccgacgttaccgggttccgggtccccgaccggtacggtaccggtaccgggaaagggggaacgggtacgtaggtaacttgttcgttacgtaggtaaggttaattaaggaaagttagaggtaacgtaaataactaagttattaattagtacgtaactaaacgttcgtaggtaaggaacggtataacggtaaccttaccaacccgttacttacccggaacggtaacggtaaactaaaccgtaaccccggaaagtaacccgactttaggttaacttactttaaccgtaacggaacgggttccggaaccgtcggtaacggttaggaaccggttcggtaccggtaaagggaacccgggtaccgtacggtttaagttaacggttagttttacggaaggggttaacggggtaggggaaaggggttacggtacgggttaaaaccgggggtttacggtttaaaagggggtccgggggtttaaggggttccgggggaacccgggggccgggttaaaggtcccccgggg

SEQ ID NO: 267178 - DNA, 678 bp, Homo sapiens
  misc_feature: GYAE6OF01CZMJ0.28.57.F02.1.454.CMB.1.raw
  modified_base (599)..(599): a, c, t, g, unknown or other
  misc_feature (599)..(599): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctgggtggagtcgtgggggagcgttggtccagccggtcggggggtccctgagactctctgtgcagcctcgtgtacttccaccttacaagtttatttaagtcgtctatcgactacggtcgggtcccgccgacggccgtaccggaaggggaacggacgtaggtaatagttcgtctagtaggttaattaaggaagttaatgaacgtaaataactaattattaattatcgtaactaaactgtagaggaacggatagtacttaccacctatccgaacggaacggtaactaaacttaccgaaagaaccactacgttagtaacttactttaacgaaggttcgggaacacgtccgttagacggtagacgtaggaacggtacgaccggtataggttaccgttaagttacggngggttacgggaaggtacgggacgtaaggggttaagttacggggtaaacggttgggggttcggcggggacgtaacggggg

SEQ ID NO: 267179 - DNA, 547 bp, Homo sapiens
  misc_feature: GYAE6OF01BDKRH.28.57.F02.1.454.CMB.1.raw
  modified_base (421)..(421): a, c, t, g, unknown or other
  misc_feature (421)..(421): n is a, c, g, or t
  modified_base (501)..(501): a, c, t, g, unknown or other
  misc_feature (501)..(501): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgagggaagggactggaatatgtctcaggtattagaagtaatgcgaaataacatatattatgacaaactctgtgaagggcagtattcaccatctccaggaacattaccaagaacncgctgtatcttacaagtgggcagccctggagagtctagaggaccaggctaggtattagttacgtggtgggaggagggagngggaaagtttgggaagttagggtttgggacggggtcgtaacggggg

SEQ ID NO: 267180 - DNA, 939 bp, Homo sapiens
  misc_feature: GYAE6OF01A4VC8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggtgtaccgagtggtggtaggtgcgagtcgtgggtggagtcggtgggggaggtcgttggtccgacggtccggtcggggggtccctaggacgtacctctccgtgtcgcgacgtcctcgtaggacttccaccttctagttatttagtgtctagtcgcgtacgtcggtcccgccgaggtccgtaccggaagggtaaggtacgtaaggtaattacgtgtacgttacgtaaggttaacgttaaaggaaagttaagtacggaaacgttaaaacttaaacgtaattaaagtttaagtttaaacgtacgtaaaccttaaaacgttccgttagggttaaacgggaaacgggtaccgttaaacggttaccgtttaaccccggtaacttaaccgttaccccggtaacccgggtaaagggttaaaacccttaaaccgttaaacccgaaaacggtaacccgtaacggttaccgttaacggtttaaactaccgtttaaacgtaacgggttacccggggaactaaccgggtaccgtaacggtaaaccgggttacggtaacccggttaacggggaacccgggtaaccggtaaccgggttacgtttaaacggttaaaccgtttaaaccggtttacggggtaccggggtttaagggggaaccgggttaaaggggttacggggtaaaccggttaaacgggggtttaaaccgggttaacgggggtttaacgggggttttaccgggggaaccggggggtaaccccggttaacccgggggg

SEQ ID NO: 267181 - DNA, 770 bp, Homo sapiens
  misc_feature: GYAE6OF01D9AI1.28.57.F02.1.454.CMB.1.raw
  modified_base (211)..(211): a, c, t, g, unknown or other
  misc_feature (211)..(211): n is a, c, g, or t
  modified_base (332)..(332): a, c, t, g, unknown or other
  misc_feature (332)..(332): n is a, c, g, or t
tcagagtacgctatcacgaccggtgctcgatttagctcgatatagttgggtctgggagaggagcccccgcccctgggtttccccaggtgttctctatttggtgatcagcactgcacacagaagagtcatgacggtagtttgggctggagtcgttgggttttcctttgttgtacttaagtttttaaaggtcgtcctaggttgtggaggtcgngagtcgtgggtgggagtcgggtgggggacgtcgttcggtccgacgtccgggtcgggggtccctgacgtcctcctcgtgtgcgacgtcctcgtagtcttccctaccttgtaagttattttanggtctagtcgtccgtacgtccgggttaccgcgtcgaccgtacggggaagggtaagtcgtaggactagtcgtacgtagagttttaccgaaggttaaatagtacgtaactaataatattaattaattacggacgtaacttaaaccgtacgttaggtaaaggaaccgtagaacgttactaacccctaactaccttacccggtaaccggtaaaggaaaccttaaccgtaacccggaaaacaccgtaaccgttacgtacgttacccgtttacgaacgtaaaggttccgggaacctacgggtcccttaggaccggtacgtacgggttacggaccgtaacgcgggtactttaggtactttacggtaggtgggtagggaacggtgggtaacggtacgtaaggttcgggaaacgggttggggttcggaccgggtcggtaacccgggg

SEQ ID NO: 267182 - DNA, 226 bp, Homo sapiens
  misc_feature: GYAE6OF01B4FND.28.57.F02.1.454.CMB.1.raw
  modified_base (222)..(226): a, c, t, g, unknown or other
  misc_feature (222)..(226): n is a, c, g, or t
tcagagtacgctatcacgaccggtgctcgatttagctcgatatagttgggttgtggggccagggagccctggtcaccgtctcctcagcctccaccaagggcccatcggtcttccccctggcgccctgctccaggagcacctccgagagcacagcggccctgggctgcctggtcaaggactacttccatagcgtactctgagcgggctggcaaggcgcatagnnnnn

SEQ ID NO: 267183 - DNA, 595 bp, Homo sapiens
  misc_feature: GYAE6OF01DVKVU.28.57.F02.1.454.CMB.1.raw
  modified_base (300)..(300): a, c, t, g, unknown or other
  misc_feature (300)..(300): n is a, c, g, or t
  modified_base (354)..(354): a, c, t, g, unknown or other
  misc_feature (354)..(354): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtcagtgtgaggtgcagctggtggagtcgtgggggaggcgttggtccagccgtgggggtccctgagactctcctgtcgcagcctctgacttcaccttcagttattatgctatgcacgtggtccnccaggctccgaggggagggactaggaatatgtactcgagttattaagaagtaanagacgtaaataacataataattatgaacaactctggtacggaaggtcagtacttaccaactattccaacggacggaactaactaccgaaagaactcgcttagtatccttaagaagtcgggcagtccgagacgagtcgtaggacggacgtacggtctaagttatagttacggtgggaggacggaagggtagacggtaaggtttacggaaaggtttggggtacgggtggggcccgtaaggggg

SEQ ID NO: 267184 - DNA, 751 bp, Homo sapiens
  misc_feature: GYAE6OF01DK032.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctcgtggtattccacctttcagtttaatttatgcttatcgcctacgttcggggtcccgccgaacggtcctaccggaaggggaacgggtactagggtaattagtgtacttacgtaggttaattaaggtaaagttaagtaggtaacgaaaacttaaacattaatttaatttagacgtaacctaaacgtcgttaggtaacggtaagggactagtacttaccaacctaacttccgtaacggaaaggtaaccttaaacgtaaccgaaacgaacctacgtaccttagttacttccttaaacgaaaggttcggactaacggtcctaaggagtacggtacgtacggtaacggacggtaaccggttcttaacgttaacgtttaacgttacgggtaaggggttaaggggaacggtaacggggtaacggaaccgggtttaaagttaccgggttaaaacggggttggggtttaggggacccgggggtacggtaaacccgggggg

SEQ ID NO: 267185 - DNA, 571 bp, Homo sapiens
  misc_feature: GYAE6OF01BB291.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctgattcaccttcagtatttatgctatgcacgtgggtcccgccaggctccgagggaagggactggaatatgtctcgaggtattagaagtaatgacgtaataacattataattatagactaaactctgtaggaaggcagattcaccatctaccgaggactaattaccaaagtaaccacgtactagtactctttacaagtcgggacagcctagagagtctaggaggacacggtctagttactagttacgtggtagggaggagggaggaggtaagttacgggaacgttaggggttcggtgggggccgtaacggggg

SEQ ID NO: 267186 - DNA, 863 bp, Homo sapiens
  misc_feature: GYAE6OF01EHUI6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagcgttgggtttttccttgttgtcttaagttttttaaaggtgtccagttgtgaggtgcagcgtggtggagtcggtgggggaggtcgttgggtccaggccggttcggggggtccctggacgtacctcctccgtggtcgcgacgtccctcgtggtactttcccaccctttcgtaagtttatttaagtcgacttatcgcctacggttccggggtcccgaccgagggtcccgtaccggaagggggaacggggtaacgtagggtaattagttagttccgtacgtaaggttaattaaggtaaagtaatacggaacgttaaaataaacgtaattaagttaatttaagtacgtaacctaaacgttcgttaggtagggaaacgggtactaaaggttacttaccctaaacctagtttccccgtaaccggaaagggtaaaccttaaacgttaacccgaaacgaacccgtaccgttaccgttagtttaaccttaccgtttaaccgaaacgggtcgggtaaccgtaaccgttccgtaacgggtaagtaaccggttacgtaacggggaacggtacccggtaaccgggttacttaacggtttaaacttaaggtttttaccgggtaggggttaaggggggaaaggtaaccggggaaggtaaacggggttaaaggtttagggggtaaaacgggtttggggggtttacggggaccggggtcgggtaaaacccggggg

SEQ ID NO: 267187 - DNA, 604 bp, Homo sapiens
  misc_feature: GYAE6OF01B9JZT.28.57.F02.1.454.CMB.1.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (459)..(459): a, c, t, g, unknown or other
  misc_feature (459)..(459): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttntagctatcgctactcgggtcccgccaggcctaccgaggggaacgggactagggaatntggtctcgaggtattaagaagtaatgacgaataacattataattatcgacaaactcgtggtagaaagggcagtattacaccatctacgaggaactaattaccgaaagaacacgactgtactnttaaccaagtcggcagccctaggagacgtcgtagaacggacgacggtcttaggtataacgtttacgtgggtaggggtacggagggacggtacgggtaacgtttacgggaaacgttagggggttagcggggggtaccgaacggggg

SEQ ID NO: 267188 - DNA, 740 bp, Homo sapiens
  misc_feature: GYAE6OF01BR1GD.28.57.F02.1.454.CMB.1.raw
  modified_base (334)..(334): a, c, t, g, unknown or other
  misc_feature (334)..(334): n is a, c, g, or t
  modified_base (449)..(449): a, c, t, g, unknown or other
  misc_feature (449)..(449): n is a, c, g, or t
tcagagtacgctatcacgaccggtgctcgatttagctcgatatagttgggtctgggagaggagccccccgcccctgggttcccaggtcgttcgtcaagtttggtagtactacagcactgcacgacgagaaggagtacgagtgaacggtagtttgggctgagtcttgggttttccttgttgcttaagtttttaaaggtgtccagtgtgaggtgcagctggtggagtcgtgggggagtcgttggtccaggccgtggggggtccctggacgactctccgtgtgcagtcctcgtggattcaccttcagttatttatgctatgcacgtcgggtccgccncggcctaccggaaggggaacggtactaggaatatgtcctagtaggttaagttaagaacgttaatcggaacgtaaataacgattaatattagtagactaaatcgtagtagaacggnaagtacttacaacctattacccgtacgaacggaaactaacgttaaccgaaacgaaccgtaccgtaacgttacgttaacgttaccgttaaaccgtaaaggttccgggtaacctaacgggtacccgttaagggaacgtaacggtaccgttaacgggaacgggtaaccgacccggttagttaacggttaagttaaccgtttaggtagggttaacgggaggtaaggtacgggtaacggttaagttaccgggtaaaggttacgggggtttacggaccgggggtccgtaaaccgggg

SEQ ID NO: 267189 - DNA, 815 bp, Homo sapiens
  misc_feature: GYAE6OF01CQIJI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtcgtgggggagcttggtccagccgtggggggtccctgagctctcctgtgcagcctgtggattccaccttcagtttactttatgtctagtcgctacgtcggggtcccgccgacgggtcctcccggaaggggggaacgggtacgtagggtaaattagttacgttcctacgtaagggttaattaaggtaaaggttaagtagaaccgtaaaagttaaaacctaagtttaatttaaagtttaacgtaggtaacccttaaaaactttcggttaaggttacgggaaacgggggtactaacggttaactttacccgaaccctacgttaccgtaccccggaaggggtaaccctaaacgtttaacccgaaacgtaaacccgacggtaccttacgttaacttaccgtttaacgaaggttccgggactaacgtacccgtaggaaggtacgtcgtaagggtaccggtacgggaaccggttccgttagttaacgttacggtttaacgggtcggggttaaggggtaagggaacggggtaacgggtaacgggggtttaaggttaacgggggttaaaccgggttaaggggggttttacgggccggggggggtacccggtaaacgggggg

SEQ ID NO: 267190 - DNA, 566 bp, Homo sapiens
  misc_feature: GYAE6OF01ASU2A.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtgggtccgccgaggcctccgagggagggactaggaatagtgtctacgaggtattagaagtatgacgaataacatatattatgacaaactcgtagtagaagggcagtacttccactatcctaccgaacgggactaacttaccaaagaccacgctacgtactcttacaagtcgggacagaccgtagagagacgtagacgacgacgtctagttatacgttagtggtagggagaggacgaggtagttagggacgttagggtggcgggcgtacgggg

SEQ ID NO: 267191 - DNA, 880 bp, Homo sapiens
  misc_feature: GYAE6OF01A3WE2.28.57.F02.1.454.CMB.1.raw
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggtcgttggtccaggccgtcggggggtccctgagactctccgtgtgcagcctcgtggacttccaccttcagtattttatgctatgcacgtcgggtccnccgaggctaccggagggtaacgggactagggaattatcggttactcgtaaggttaagttaagaaagttaaagtacggacgtaaaacttaaacgaattaaatttaacttaagtacggaacctaaaaacgttcgttaggttaagggaaacggggtaccgtaaggtaacttacccgaaacccgttaacgttaccccgttaaaccggtaaacggggtaaacccttaaaccgtttaaccccggaaaaacggtaaacccgtaaacccggtaccgtttaacggtttaaccctttaacccgtttaacggtaaaacggttaccgggggtaacccgttaaaccgggtaaccccggttaaggtaaacggggtaccggttacgttaacgggtaacggggtaaacccgtaacggggtacccgttaaggttaacgtttaaacgtttaccgggttagggtagggggtaacggggtaaacggggttaacgggaacccgggtttaaagggtttacggggttaaaacccgggttaggggggttttacgggttaaccggggggggtaaccggttaaaccgggggggg

SEQ ID NO: 267192 - DNA, 669 bp, Homo sapiens
  misc_feature: GYAE6OF01DA8MI.28.57.F02.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (655)..(655): a, c, t, g, unknown or other
  misc_feature (655)..(655): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtccctgagactctccgtgtgcagcctcgtggacttcacttcagttatttangtctatgccacgtgggtcccnccgaggcctaccggaagggaacggactagggaatagtgtacctagaggttaattaagaagtaatagacgtaaataacataatattatgaactaaactctaggtagaagggtacagtacttcctaacactccgtaccgaaggaacttaaccgtacaaaacgaaccgacggtacctagttactacttaacggtaaagtcgggacttaccggaccgttaggaagtacgagtacggggaacgacggacgggtactaacgttagttaagttcggtaggggtaacggggtagaaggggtacggaacgggttaaacggttaagggtaagggttagggggtttgggtaacccgggggngggttaacccgggg

SEQ ID NO: 267193 - DNA, 812 bp, Homo sapiens
  misc_feature: GYAE6OF01DIA25.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtgacttcaccttcagttatttatgctatcgcacgtcgggtccnccgacggcctaccggaaggggaacgggtacgtaggtaaattagtacgttacctacgtaaggttaaattaaggaaagttaagtcggaacgtaaaattaaacctaattaaattaatttaacgacgtaaaccctaaaacgtttcgtagggttaacgggaaacgggtacgaagttaaccgtttaccgaaacccgtaacgtttaccccgtaacccgggtaaacgggtaaacctaaaccgtttaaacccgaaaacgtaaccgtaacccgtacgttaaccggtttaacttaccctttaaacggaaacggttcggggtaactaaccggtcccgttaggaacgtacggtacgttacgggaacgggtaccgtaacgggttacgttacggttaaactttacggttaccggttaggggtacggggtaaggtaacggggtaagggttacgggttaaacgggtttacgggtaaacgggtttagggggttacggggtacggggggtaccggtaaaccgggggg

SEQ ID NO: 267194 - DNA, 711 bp, Homo sapiens
  misc_feature: GYAE6OF01BJPES.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgctattttaaaggtgtccagtgtgaggtgcagctggtggagtcgtgggggagcgttggtccagccgtgggggtccctgacgactcctcctgtgcagcctgtgtacttccaccttcagttattacgtgctagtcgctacgtacggtccgccgaggtcctaccggaagggaacggtacgtaggaatgtcgtacttcgaaggttaataacggaaagtacgtacgtaacgaaaattaaacgtaattaagtaactttaagacgaactaaaaccttgttaggtacggtaaacgggtactaagtacttaccgaacctacgtaccgtaacgaacgggtaaccttaacgtaaccgtaaacgaaccgacgtacgtacgttaacttcgtaactaacggacgggacaaccgtccttaaggacgtacgacgtacggaacggacgtaaccggtcgttaagttaaacgttacgttaacggtgggttaacgggaggtacggaacgggtacggttaaaggttacggtaacggttaggggttcggtacgggggtaccggtaacgggg

SEQ ID NO: 267195 - DNA, 707 bp, Homo sapiens
  misc_feature: GYAE6OF01BD53T.28.57.F02.1.454.CMB.1.raw
  modified_base (570)..(570): a, c, t, g, unknown or other
  misc_feature (570)..(570): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggtgtcctagtgtgaggtgcagcgtggtggaggtcggtgggggtaggtcgttggtccgacggtccggtcgggggtccctggacgtactcctccgtgtcgcacgtcctcgtggtacttcctacctttactagttatttagtgtcttagtcgaccgtacggttcggggtcccgaccgtaacggtcccgtaccggaaagggggtaacggtaacggtaggtaaacttacgttggttaccgtacggtaaggttaaagttaaaggtaaaagttaagtacgtaacgtaaaattaaactaattaattaacgttatacgtaactaaacgtcgtaggtacggtaaggactagtactacacctatacctacgaagtactaactacgaaacgtactaccgtntagtatacgttaagaacgtgactacgtctaggagtacgagtaggacgtactcggtatacgttaattagtaggtggaggggagtagggtacgttagggaaggttacggtaggttagggtcgggtcgggacggtacggg

SEQ ID NO: 267196 - DNA, 696 bp, Homo sapiens
  misc_feature: GYAE6OF01DA2GN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgcttattttaaaggtgtccagtgtgaggtgcagcgtgggtggagtcgtgggggaggtcgttggtccaggccgtgggggtccctgagctctccgtgtcgctacgcctcgtggtacttcctaccttcgagttaatttagtcgtactatgacctcgttcggggccccgaccgacggccgtacgacggggaaggaccgtagggaatagtgtctacgaggttaattaaggaagtaagtacgaacgtaaaataactaattaagttaacttaagtacgtaactaaacttcgtaggtagggtaaggaccgtaatacgtacacctaacgtacctaccgtaagggtaactaacgtaaccgaaaggaaccacggtacctagtattaccgtaactaaaggtccgggtacacgttaccgaggtaacgggacacggtagaacggtaccgacgtatacgtattagtacgtagggtaggaacggcgggtacgtaacggttaacgttacgggtaaacggttagggggttcgggtaagggggcccgtaacggggg

SEQ ID NO: 267197 - DNA, 708 bp, Homo sapiens
  misc_feature: GYAE6OF01D1DI6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggtacttccaccttcagttatttatgctatgcacgtcgggtcccgccgaggtcctaccggaggggaacgggactagggaattagtgttacctacgtaaggttaagttaaggaaagttaatacggaacgtaaataaacgaattaatttaactttaatcggaactaaaaccttgtaaggtaggaaaggggactagtacttaccacctagtcctaccggaagggtaactaacgttaccaaaggtaacctacggtaccttagttaacttaccgtttaacgaaacggttcggggaccaacggtcccgttaggaacggtacgtacgtaagggacggtaccgacggtacttaggttaacttacgttacggtaggtaggggaacggaggggtacgtacgggtaaaggttagggtaacggttagggggtttcgggtacggggccgtaaccgggggg

SEQ ID NO: 267198 - DNA, 909 bp, Homo sapiens
  misc_feature: GYAE6OF01EB9EZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtcgtgggggaggcttggtccagccgtggggggtccctgacgactctcctgtgcagcctctggattcaccttcagttatttatgctatgcacgtcggggtcccgaccgaggcctccggaagggggaacgggacgtagggtaaattagttacgtctacgaagggttaacttaaggtaaagttaagtagaaccggtaaaataaactaattaattaatttaagtacggtaacctaaacgttccgttaggtaacggtaaacggggacctaagggtaacctttaccaaccctaacgttacccgtaacccgtaacggggtaaacctaaaccgttttaaacccgaaacggtaaacccgtaacccgtttaccgttaacggtttaacctttaacccgtttaacggtaaaaggttccggggtaaccgtaaaccggttccccggtaagggtaaaccgggtacgttaacccgggttaacggggtaaaccggggtaacccgaaccgggggttaccttttaacggggtttaaaccgtttaaaacggttttttacccggttaaggggggggttttaacggggaaaggggggttaaaacggggtaacggggggttaaaccgggttaaaaacggggttttaaccggggttaaaaacgggggttttacgggggggttttaacggggggttaacgggggggaccccggggttaaaacggggggggg

SEQ ID NO: 267199 - DNA, 729 bp, Homo sapiens
  misc_feature: GYAE6OF01C82DX.28.57.F02.1.454.CMB.1.raw
  modified_base (257)..(257): a, c, t, g, unknown or other
  misc_feature (257)..(257): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaggtgtccagtgtgaggtgcagctggtggagtcgtgggggagtcgttggtccagccgtggggggtccctgagctctccgtgtgcncgcctctggattccaccttcagttatttatgtctatgcacgtcgggtcccgccgcggcctccggaaggggaacgggactagggaattagtgttctacgaggttaagttaagtaagtaagtcgaacgtaaataacattaattattatagaactaaacttcgtaggtagaacgggtacaagtacttaccgaacctacttaccgtaccgaacgggtaacctaaacgttaacccgaaacgaaccgaccggtacttacgttactttacccgtttaagaaacggttcgggaccgtaacggtccgttagggaacggtagtacggtacggaacgggtaccgacgggttaccgttagttaaacgtttaacgttacggttagggtaacgggggaagggtaccggggtaaggtaacgggtaaaggtttacgggggtaacggtttaaggggggttgggtaccgggggtacccggtaacgggggg

SEQ ID NO: 267200 - DNA, 662 bp, Homo sapiens
  misc_feature: GYAE6OF01CO75P.28.57.F02.1.454.CMB.1.raw
  modified_base (213)..(213): a, c, t, g, unknown or other
  misc_feature (213)..(213): n is a, c, g, or t
  modified_base (262)..(262): a, c, t, g, unknown or other
  misc_feature (262)..(262): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttggtttcctgttgcttattttaaggtgtccagtgtgaggtgcagcgtggtggagtcgtagggggngtcttggtccaggtcccgtcggggggtcctggacgtcctcgtccgttgngcgacgtcctcgtggtacttccaacctttctaagtttattangtactatcgcgtacgtcggggtccacgacgtaccgtcggaggggaacggtcgtaggaatagtcgtaccgtagtagtaagttaaggaagtagtacgaaacgtaaataactaaagtacttaagttactaacgtaacctaaaccgtgttaaggttacgaaaggggtataactcttaaccgactacgtaccgacgacgtaaactacgtaacaagactacgactagtctacgtataagtccggtactacgacggtagagtacgacgtacggacgtaacgcgtagtgttaagtacgttaggacggtaggaggtaggacggtagtaacggtcgtaaacgggtgggtacgggtgggccggtacggg

SEQ ID NO: 267201 - DNA, 673 bp, Homo sapiens
  misc_feature: GYAE6OF01BTXLL.28.57.F02.1.454.CMB.1.raw
  modified_base (400)..(400): a, c, t, g, unknown or other
  misc_feature (400)..(400): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtagtgggggagcttggtccagccgtgggggtccctgagactctcctgtgcagtcctcgtgtattccaccttcatttatttatgtcttatgcacgtcgggtcccgccgaggcctaccgaaggggaacggacgtaggaattagtcgttactacgaggttattaaagtaagtaatgactaaataactatatattatnaacctaaatgtagtaggaggactagtacttacaacctatacctacgaacggtaactaactaaccaaagacacgtctagtacttacgtataagtgggaccagtacccgaggtacgacgtagtacgaacggtaccgtacggttctaaggttacgtttaacttaaccgggtagggttaaggggaacgggtaaggggtaacggtaacggggttaaaggtttaacggggtaacgggtttaagggggtttcggggtacggggcccggggtaaccggggg

SEQ ID NO: 267202 - DNA, 645 bp, Homo sapiens
  misc_feature: GYAE6OF01BPLOO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtggggggagcttggtccagccgtggggggtccctgagactctcctgtgcagcctctggattcaccttcagttatttatgctatgcacgtcgggtcccgccgacggcctccggaaggggaacgggacgtaggaatagtgtctacgtaggttaattaagaagtaatgacgaaataacattattaattatagactaaactcgtagtaggaaggcagtattccgaacctacttccgtaccgaaggaactaacgttaaccgaaacgaaccacggtctagtacttacttacgtaaagtcgggactacgcgtaggagtacgcgtaggaacggacgaccggtgttacgttaatacgtttacgtgggtagggaaggtacgggacggtaacgggtaaggttacgggtaacggtttaggggttaggggtacgggggccggtaacggggg

SEQ ID NO: 267203 - DNA, 762 bp, Homo sapiens
  misc_feature: GYAE6OF01EHTYW.28.57.F02.1.454.CMB.1.raw
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtggtggagttcggtgggggaggtcgttcgggtccaggtcccggttggggggtcccctgacgtacctcctccgtgtcgcgacgtcctcgtggtacttcctaccttcgtagttatttangtacttagtcgacctacgttcggggccctacgacgggtccttaccggaaggggaacggtacgtaggtaacttagttcgtacttacgtaaggttaattaaggtaaacgtaatacggaacgtaaaataacgtaattaattaatttatacgtaactaaaacgttcgtaggtaacggaagggtactaagtaacttaccgacctacgttacccgtaccggaacggtaacctaaacgttaccgaaacgtaaccgaaccgttaccttagttacttaccgtaacgtaaggtcggacgtacgaccgttaggaacgtacggtcgtacgggaacggaccgtacggtacgttagttaacgttagtttacgtggggtagggaacggtacgggacggttaaggtaacgggttacgggtaacgggtttaggggttcgggtacgggggtccggtaaccggggg

SEQ ID NO: 267204 - DNA, 787 bp, Homo sapiens
  misc_feature: GYAE6OF01BWWWM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtggggggtccctgacgtactctccgtgtcgcagcctcgtgtacttccacctttcagttatttatgtctagtgcctacgtcgggtcccgaccgacggtcctaccggaagggggaacgggtacgtagggtaattagtgttacctcgtaacggttaagttaacggtaaagttaataggaacgtaaaacttaacgtaattaattaagtttatacgtaacctaaaacctcgttaggagggtaaacgggactaacggtactttaaccgaaccctagttccccgtaacccgtacggggtaaacctaaaccgtttaaccgaaaacggtaaaccgacccggttacttaacggttaactttacccgtttaaacggtaaacggtcggggaacctaccggtacccgtagggaacgtacggtacgtaggggaaccggtaaccgacggggttcttaagttaacgttaacgtttacgggtggggttaggggaagggtaagggtacgggtaagggttaaacggttggggtaaaccgggtttgggggttagggtacccgggggaccggtaaaccggggg

SEQ ID NO: 267205 - DNA, 773 bp, Homo sapiens
  misc_feature: GYAE6OF01EV73Y.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagtcgttgggttttccttgttgtcttaagtttttaaaggtgtccagtgtgaggtgcagctgggtggagtcggtgggggagtcgttggccgaggtccggttcggggggtccctggacgtacctcctccgtgtgcagtcctgtgtacttcctaccttctagttatttatcgtactagtcgccgtacgttcggggtcccgccgtacggcccgttacggaagggggaacggtacggtaggtaagtacgttcgtcgttacgtaaggttaattaaggaaagttataggaaacgtaaataaactaataatttaattagtcgtaacgtaaacttcgtaggtaaggaacggtacgtaagttacttacccgaacctagtccgttaaaccggaacggttaaactaaccgttaaccgaaaacggtaaccgtaccgtacgttaacgttaccttaacgttacgtaaacggtcgggaacgtacgtaccgtaggacgtaagtaccggtagggacgtaaccgtacggtacgttaattcggtaacttaacgggtgggtaagggacggtaacgggtaacgggtaacggttaacgggttaacggggtaacggggttgggttaccgggggtaagggcccggttaacggggg

SEQ ID NO: 267206 - DNA, 754 bp, Homo sapiens
  misc_feature: GYAE6OF01BDC5N.28.57.F02.1.454.CMB.1.raw
  modified_base (172)..(172): a, c, t, g, unknown or other
  misc_feature (172)..(172): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctattttaaaggngtcagtgtgaggtgcagctgggtggagtcgtgggggagcgttgggtccaggccgtggggggtccctggacgactcctcctgtcgcacgcctcgtggacttccgaccttcaagttatttatgacttatgctacgttcggggtcccgccgagggcctaccggaagggggaagggtactagggaattagtcgttctacgtaaggttaattaaggaaagttaactaggaacgtaaaattaacaatttaattaatttaatacgaacctaaaacttcgtaggttaggaaagggtacaacgtacttaccaacgtactccgtaaccgagggaaactaacgtaccgaaagaaccgacgtacgttacgtaattccttaacgtaaagtccgggtacgacgtacccggtagaacggtacggtccgtagggaaccggacggacggtacgttaaggttagttaaccggtttaagggtgggtaagggggtaacggtaacggggtaacggggttaaccgggttaaaacgggtttaaggggtaaacccgggtttagggggggttttcgggtaaccggggggttacccggaaacgggggg

SEQ ID NO: 267207 - DNA, 782 bp, Homo sapiens
  misc_feature: GYAE6OF01CPUAN.28.57.F02.1.454.CMB.1.raw
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtaggtttgggctgagcttgggttttccttgttgtcttaagtttttaaaggtgtccagtgtgaggtgcagcgtgggtggagtcgtggggggagtcgttggtccacgtccggtcgggggggtccctaggacgtaccttccgttccgtggtgaccgcgtccttcgtggtactttccaaccctttnaagtttattttacgtgtaccttagtcgactacggtcggggtcccncccgtaggtcccgtaccggaagggggaaacggtacgttagggtaaactagtcgttactacgtaaggttaattaaggaagttaataggaaacgtaaataaacgtaatttaagtaattagtacgaactaaaaccttgttaggacggaaacgggtnaacggttaacttacccgaactacgttacccaaccggaaggtaaacctaaacgttaaacccgaaagtaaccgtaccgttacgtagtacttacttaacgaaagtcgggacacggtactaggtagacgtcgtaaggaccggtacgacccgggtatacggttaaagttacggtttaacgtagggtaaggggtaaggtaacgggtaacgtaccggggttaagttaacggggtaaacggttgggggtttacggtacgggggtcccggtaaacgggg

SEQ ID NO: 267208 - DNA, 728 bp, Homo sapiens
  misc_feature: GYAE6OF01CL67B.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctctggattccaccttcagttatttatgcttagtcgctacgtcgggtcccgaccgacggtcctaccggaagggggaacgggtacgtagggtaaacttagtcgttacgtacgtaagggttaactttaaggaaagttaagtacggaacgtaaaattaaacaattaagttaattaagtacgtaactaaaccgttcgttaggtaggaaacggggtacaaggtactttaccaaccctagttcccgtaccggaaagggtaaccttaaacgttacccgaaagtaaccctacggtacttacgtaacttaccgttaacgaaaggttcgggactaacggtacctaggacggtcgacgttacggacggtaccgacggtctagttaattacgttacggtgggtagggaaggacgggtagtaaccgggttaaagttacggggtaacgggtttagggggttacggtcgggggaccgtaacggggg

SEQ ID NO: 267209 - DNA, 583 bp, Homo sapiens
  misc_feature: GYAE6OF01EM8WV.28.57.F02.1.454.CMB.1.raw
  modified_base (327)..(327): a, c, t, g, unknown or other
  misc_feature (327)..(327): n is a, c, g, or t
  modified_base (365)..(365): a, c, t, g, unknown or other
  misc_feature (365)..(365): n is a, c, g, or t
  modified_base (439)..(439): a, c, t, g, unknown or other
  misc_feature (439)..(439): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggcttgagctgggttttccttgttgctatttttaaaggtgtccagtgtgaggtgcagctggtggagtcgtgggggaggcttggtccagccgtggggggtccctgagactctcctgtgcagcctcgtggattcaccttcagtatttatgctatgcactgggtccgcaggctccgagggaaggctggaatangtctcaggtattagaatatgacgaataacatatattangactaaactcgtgtagaagggcaagtattccacatctccagggaactaattccaaagaacacgatgtatcttanaaagtcgggacaacgcctaggaacgagacgttagacggaacgacggtcttagttaagtagtttacgtggtaacggggaggtaacgggaggtacggtaaagttacgggaacgttagggggtttcggtcgggggccgtaacggggg

SEQ ID NO: 267210 - DNA, 674 bp, Homo sapiens
  misc_feature: GYAE6OF01EP6TB.28.57.F02.1.454.CMB.1.raw
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccggtggggggtccctgagacctctcctgtgcagcctntggtattccacctttcaagttattttangcttatcgccgtacgtcggggtcccgccgagggccctaccggaagggggaacgggtacgtagggaaattagttcgtccttacgaaggtttaattaaggaaagtaatggaacgtaaataactattaattattaatgactaaactcgtgtacgaaggcagtacttaccaacctataccgtacaaggaacctaagttaccgaaacgaacaccgtacttgttaacttcttacaaaggtggacacggtcctaggacgagtctagggacgacgaccgtcgttacgtaattacgttacgtgggtacgggaaggtacgggacggttaacgggaaggtttacggggaaacggtttagggggtttcggggtacgggggccggtaaacggggg

SEQ ID NO: 267211 - DNA, 537 bp, Homo sapiens
  misc_feature: GYAE6OF01EZFMG.28.57.F02.1.454.CMB.1.raw
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaggactggaatatgtctcgagtatagaatatgacaataacatatattangactaaactntgtagaaggcagtatcacatctaccgaggactaactacaagacacgctgtatctacaagtggacagctagagagacgtgaggacgacggtcgtagttatagttacgtggtagggaggaggaggacggtaagttacgggaacgttagggttcggtggggcgtacgggg

SEQ ID NO: 267212 - DNA, 646 bp, Homo sapiens
  misc_feature: GYAE6OF01A6K6V.28.57.F02.1.454.CMB.1.raw
  modified_base (242)..(242): a, c, t, g, unknown or other
  misc_feature (242)..(242): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgngactctcctgtgcagcctctggacttccaccttcagttatttatgtctatgcacgtcgggtcccgccgaggcctaccgaggggaagggactaggaatagtgtctacgtaggtattaagaaagttagtggacgtaaataactagtaattattaatcgaacaaacttcgtaggtaggaaaggcagtacttacaaccctatacctaccggaaggtaactaacttacccaaagaaccaccgtactagtacttctaactaagtcgggactacgcgtaggagacgtacgtaggaacgtacgtaccggtattaggttaattacgttacggtgggaggggagggaggacgggtaacggttaaggttacgggtaacggttagggggttcgggtaccgggggccggtacggggg

SEQ ID NO: 267213 - DNA, 734 bp, Homo sapiens
  misc_feature: GYAE6OF01ACK8V.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttagtttttaaaggtgtccagtgtgaggtgcagctggtgagtcgtgggggagtcttggtccagccgtggggggtccctggagctctcctgtgcacgtcctctggtacttccacctttcagttatttatcgtctatcgctacgtcgggtaccccgccgacggtccctccggaaggggaaacgggtacgtagggtaaacttgtacgttccgtaccgtaaggttacgttaaagtaaaggttaacgtaggaaccggtaaaaacttaaacgtaatttaagtttaactttaagtacgtaaacctaaaacgtttcggtaggtaacgggaacggtacaagttaccttacccaacctataccccgtaccggaagggtaaccttaacgttacccgaaaaggaccctaaccggtcttaacgttaacttacgttaacgaaaggtccgggacctagtcgtaggagtacgcgtaaggacgtaccgacgtctaggttacttagttcgggtgggtaggaggtaggaggttaacggtaaggttacggggtaacggttggggtttacgggccggggtcgtaacggggg

SEQ ID NO: 267214 - DNA, 734 bp, Homo sapiens
  misc_feature: GYAE6OF01A86C6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttggttttccttgttgcttatttttaaaggtgtccagtgtgaggtgcagctggtggagtcgtgggggagtcgttggtccaggccgtggggggtccctgacgactctcctgtgcagcctctggacttccacctttcagttattttatgacttatgcctacgtcggtcccgccgaggccgtccgaggggaacgggactaggaatagtgtactcgtaggttattaaggaagtaagtgacgaaataacattaatattatgactaaactcgtaggtaacggaagggtacaagtacttacccaaccgtacgtaccgtaccgaacgggtaacctaaacgttaaccgaaacggaaccgtacgtaccgttaacggttaacttaccgttaaccgtaaagtacgggtacctaacggtcccgtaggtaacgacggttaccgtagggaacggtaaccgtaccggtaccggtttagtaactttaaggttccggttaagggtaggggtaaggtaaggggtacgggtaacgggttaaacggtttacgggggtaaacgggttttgggggttaacggggttcgggggtacccgggtaaaccggggg

SEQ ID NO: 267215 - DNA, 805 bp, Homo sapiens
  misc_feature: GYAE6OF01EZHP4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtccagtgtgaggtgcagctggtggagtcgtgggggagtcgttggtccaggccgtggggggtcccctggacgtacctcctccgtgtcgcagcctcgtggtacttccaccttctaagttatttagtgtactatcgtccgtacgtcggggtcccgtaccgacggtccgtacccggaagggggaaacgggtaccgtaggaaacttagtcgttccgttacgtaaagggttaagtttaaaaggtaaagttaaagtacggtaacgtaaaaagttaaacctaatttaaagtttaatttaacgtaacgtaaacctaaaaccgttcgttagggtaacggtaaacggggtctaacggttaacttacccgaaccctacgtccgtaacccgggtaacggtaaacctaaaccgttaccgaaaacgtaaccgtacccggtacgtttacgttaaccgtttacgttaaaccgtaaagtcgggtaacaccgggtacctaaggagaccgtcgtaacgggacgtaccgaaccggtgttacgtaacgttagttacggtcgggttaacggggaggtaacgggaggtaaccggttaagggttacgggttaaacggttagggggttcgggtaccggggcggtaaccggggg

SEQ ID NO: 267216 - DNA, 757 bp, Homo sapiens
  misc_feature: GYAE6OF01DT7WH.28.57.F02.1.454.CMB.1.raw
  modified_base (178)..(178): a, c, t, g, unknown or other
  misc_feature (178)..(178): n is a, c, g, or t
  modified_base (685)..(685): a, c, t, g, unknown or other
  misc_feature (685)..(685): n is a, c, g, or t
  modified_base (702)..(702): a, c, t, g, unknown or other
  misc_feature (702)..(702): n is a, c, g, or t
  modified_base (746)..(746): a, c, t, g, unknown or other
  misc_feature (746)..(746): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtntccagtgtgaggtgcagctggtggagtcgtgggggaggcgttggtccaggccgtcggggggtccctgagacctcctcctgtgcacgcctcgtggtacttccacctttcaagttattttagtcgtctaatcgcgtacgtcgggttcccgaccgtagggcctaccggaagggggaaacgggtacctagggaaattagtcggttacctacggttaagggttaatttaaggtaaaaggttaagtacgaaacggtaaaattaaaactaagtttaatttaaagtttaacgtaacgtaacgttaaaaccttcggtttaaggtacgggtaaaacgggtactaaggttaacctttacccaaacctaaccgtttacccgtaaccgaaagggtaaacccttaaacgtttacccgaaaaacggaaccctacggtaccttaagttactttacccgttaaagtaaaagtccggggactaacggtcgtacggtaaggacgtccgtaggaacgtaccgacgtntagttactagttacggnggtagggagaggacggagttaaggtggaacggttagggttcggngggcgtacggg

SEQ ID NO: 267217 - DNA, 686 bp, Homo sapiens
  misc_feature: GYAE6OF01APZ28.28.57.F02.1.454.CMB.1.raw
  modified_base (243)..(243): a, c, t, g, unknown or other
  misc_feature (243)..(243): n is a, c, g, or t
  modified_base (477)..(477): a, c, t, g, unknown or other
  misc_feature (477)..(477): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtaccctgngactcgtcctgtcgacagtcctcgtggtacttccacctttcgaggttacttttagtcggccttagttggacctacggttcggggtcccgccgaggtccttaccggaagggggaacgggccttagggaaattagttcggtacgtcgtaaggttagttaagtaagtaattaggacgtaaataacgtatagtattagtgaactaactcgtgtaggaagggcagtattacactacgtntaccgaggtactaacttcaaacgacgacgtcgttagtaacttcctaagaacgttcggacacgtaccgtaaggcgaacggtgttacggaacggtcgaccggtacgttagtacgttaaagtccggttagggtacggggaagacgggaacgttacgggtaacgtttacgggaaacgggttttgggtacgggggtcgggaacggtaccggggg

SEQ ID NO: 267218 - DNA, 570 bp, Homo sapiens
  misc_feature: GYAE6OF01A4SOW.28.57.F02.1.454.CMB.1.raw
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttcagtatttatgcttatgcacgtgggtccgccaggcctccgagggaagggactggaatagtgtctcgaggtattagaagtatgacgaatacatatattatgacaaactctgtagaaggnagtactcacatctacgaggaactataccaaagaccacgtctacgtatcttacaatcgggacncgactagagtagcgtaggaaggtaccgcggtactagtacttaattacggtggtagggaaggagggagacgggtaattagggaacggtttaggggttcgggtggggtccggtaacggggg

SEQ ID NO: 267219 - DNA, 773 bp, Homo sapiens
  misc_feature: GYAE6OF01BOD65.28.57.F02.1.454.CMB.1.raw
  modified_base (286)..(286): a, c, t, g, unknown or other
  misc_feature (286)..(286): n is a, c, g, or t
  modified_base (391)..(391): a, c, t, g, unknown or other
  misc_feature (391)..(391): n is a, c, g, or t
  modified_base (666)..(666): a, c, t, g, unknown or other
  misc_feature (666)..(666): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttcctgttgctatttttaaaggtgtccagtgtgaggtgcagctggtggagtcgtgggggaggcttggtccagccgtggggggtccctgagactctcctgtgcagcctctggacttccacctttcagttatttangtctatgcctacgtggggtccccgccgaggccgtccgaaggggaaggggacttagggaattagtgtctcgtaaggttattaagaagttaacgtgacgaaactaanataatttaatttagcgtactaaaaccgtttcgtaggtaggaaacgggcgtaaggtactttaccgaaccctagttccctacccggaaagggtaacctaacttaacccgaaacgaaccctacgtacgttacgtttaacttaccgtttaaccgaaaggtttcggggacccgtaacggtcccgttaagggaaggggttacccggtacgttaaacggggaacccggggtaacgaaacccgggggttcctttaaggtttaaacgtttaacgtttaaccggnggggtttaaggggggaagtaacgggggtaacggtacggggtttaaacgtttgggggaaacggtttaggggggtttcgggggtaacggggggtcccggtaacgggggg

SEQ ID NO: 267220 - DNA, 872 bp, Homo sapiens
  misc_feature: GYAE6OF01CUUO9.28.57.F02.1.454.CMB.1.raw
  modified_base (186)..(186): a, c, t, g, unknown or other
  misc_feature (186)..(186): n is a, c, g, or t
  modified_base (863)..(863): a, c, t, g, unknown or other
  misc_feature (863)..(863): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtacttaagttttttaaaggngtccagtgtgaggtgcagcgttgggtggagtcggtgggggagtcgttcggtccgaggcccggttcggggggttcccctaggacgtaccgttccttccgttggtcgccgacgtccttcgtaggtactttccctacctttacgtagtttaacttttagtcggtaccttagtcggtacccgttacggttccgggggtacccccgaccggtaaccggttccccgttaacccggggaaaggggggttaaaacgggtacccggtttaaggggtaaaactttacggttccgtttaccgttaacgtaaggtttaaagttaaacggtaaagttaacgtacggaaacgttaaaactttaaactaagtttaactttaaagtttacgtaacggtaaacccttaaaaccgtttgtaacgggttaaacgggaaacgggtaccgtaacgtttaactttaacccgaacccttacggttaccccgttaaccggtaaacggtaaacttaaacccgttaaccgaaacgtaacgtaaccggttcgtttaacgtaacttaccgttaaaggtaacgtcgggaactcgtaacggagaccgtgacgtaaggacgacgtaccggattagtaagttacgtaggagggttagggagtagggaacggtaggttaagttacgggtaaggttggggtacggccgggnggtaccggg

SEQ ID NO: 267221 - DNA, 599 bp, Homo sapiens
  misc_feature: GYAE6OF01EA0X3.28.57.F02.1.454.CMB.1.raw
  modified_base (402)..(402): a, c, t, g, unknown or other
  misc_feature (402)..(402): n is a, c, g, or t
  modified_base (411)..(411): a, c, t, g, unknown or other
  misc_feature (411)..(411): n is a, c, g, or t
  modified_base (433)..(433): a, c, t, g, unknown or other
  misc_feature (433)..(433): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctatttaagtgtcagtgtgaggtgcagctgggtggagtcgtgggggaggcttggtccaggccgtggggggtccctgagactctctgtgcacgctcgtggtacttcaaccttctaagttatttatgtactatgctggtcgggtcccgccgtaggccgtaccggaggggtaacggacgtaggaattagtcgttactagaggttaattaagaagttatggaagaaactaaagtattattaattagtnaactaactntggaaggaggcagtactcaacntacgtacgaggtaactaacgtacaacgtactacgtattacgtatctaagtaagtcggatcgactggagactgagacgacgtgctagttatacgttacggtagggtagggaggacgggtagacggtaagggttagaacgggttaaggggcggtagggcgggtacggg

SEQ ID NO: 267222 - DNA, 745 bp, Homo sapiens
  misc_feature: GYAE6OF01D2SWJ.28.57.F02.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctntggattcaccttnagtatttangctangcacgtggtccgccaggcctccgagggaaggactaggaatatgtctcaggtatagaagtatgacgaaataacattatagttatacgtactaaaactcgttaggtacggtaaaggggataacggtaacttaccgtaaccgtattaccgttaccgggaaacgggtaacctaaacgttaaccgaaaacggtaaaccaacgtacgttacgttaacttaccgtttaacgaaaaggtttcgggaaccgaacggttaccccgtaggtaacgggaaccgtaccggttaagggtaaccggggaaccgtaaccggggactttaaccggttaagttaaacgttttaaccggttacgggttagggggaacggtaaagggggtacggaaaccggggttaaaggttaacggggtaaaccggtttaagggggggttttaccgggtacggggggttacccggtaaaccgggggg

SEQ ID NO: 267223 - DNA, 785 bp, Homo sapiens
  misc_feature: GYAE6OF01CJFLJ.28.57.F02.1.454.CMB.1.raw
  modified_base (317)..(317): a, c, t, g, unknown or other
  misc_feature (317)..(317): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagtgtggaggtgcagctggtggagtcgtgggggagcgttgggtccaggccgtggggggtccctggagactctcctgtgcagcctctggacttccaccttctagttatttagtgtctatcgctacgtcgggtcccncgtacggccgtccggaaggggaacggtacgtaggaattagtcgtaccgtacgaggttaattaaggtaagttaagtacggaaacgtaaaaccttaaaagtaatttaataagtttaacgtaggtaaacctaaaccttcgttaaggtaagggaaacgggactaacggtaaccttaacctacctaccgttaccgtacccggtaaacgggtaaactaaacttaacccgaaacgaaccctaacggtaccttacggttacttaccgttaagaaaccggtgggtaaccaaccggttacgaacggtaacgacggttacggaacggaacggtaccggtaagtccgttaagttaacgtttaaggttacggtaggggttaggggaaagggtaagggtacggtaaggggttaaaggtttacgggggtaaacgggttaggggggttttaccgggaccggggggtaaccggtaacccgggggg

SEQ ID NO: 267224 - DNA, 885 bp, Homo sapiens
  misc_feature: GYAE6OF01BTT36.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcttgttgctattttaaggtgtcagtgtgaggtgcagcgtggtggagtcgtgggggagcgttggtccaggccgtggggggtccctggagacctcctcctgtgcacgcctcgtggattccaccttcagttatttagtgcttagtcgacacgtcgggtccgccgagggcctaccggaaggggaacgggtactagggaaattagtcggtccgtacgtaaggttaattaaggaaagttaagtaggaacgaaataaacgtattaataattaatacgaactaaactcgtggtaggaacgggtcaaggttactaccgaaccctattaccgtaccggaaaacgggtaacctaactttacccgaaaacgaaacccgttaccggtacgtttacgttaacgtttacccgtttaaacgaaaacgggtttccgggaacttaacccgggtcccgtttaagggaaccggggtacggtaacccggttacggggaaaacccgggggaccgtaaacccggggtttcttaacggggttttaaaaccctttaaacgggtttttaacccgggggttaggggggtttaaacgggggggaaaacttaaacgggggggggttaaaaccgtaaacggggggggtttttaaaaacgggttttaccggggggggtaaaaacccggggttttttaaacggggggggggtttcgggggttaaacccgggggggggaaaccccccgggtttaaacggggggggg

SEQ ID NO: 267225 - DNA, 607 bp, Homo sapiens
  misc_feature: GYAE6OF01CQBBN.28.57.F02.1.454.CMB.1.raw
  modified_base (397)..(397): a, c, t, g, unknown or other
  misc_feature (397)..(397): n is a, c, g, or t
  modified_base (461)..(461): a, c, t, g, unknown or other
  misc_feature (461)..(461): n is a, c, g, or t
  modified_base (521)..(521): a, c, t, g, unknown or other
  misc_feature (521)..(521): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcgttcggtccagccgtggggggtccctgacgactctccgtgtgcagcctcgtggtacttccaccttcagttatttatgactatcgcacgtcggtcccgccgaggcctccgaggggaacggactaggaatatgtctcgtaggtaagttaagaaagtatagacgaaataacaatattaattangtacaatctaggtagaaggcagtactacaccatcctacgaggtaactaattaacccaaagaacncgacttgtacttgtaacaagtgggcaacgtcctaggaaggagtcgtagacggtacacggnttagtattacgtacggttggaagggaagtagggagtaagggttaagttacgggaaacgttgggggtcggacggggcgtaaacgggg

SEQ ID NO: 267226 - DNA, 705 bp, Homo sapiens
  misc_feature: GYAE6OF01B8UJ5.28.57.F02.1.454.CMB.1.raw
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccaggccgtggggggtccctggacgactctcctgtgcagcctctggattcacctttcagttatttatgcttatgccacgtcggggtcccnccgaggcctccgaaggggaacggggactggaatagtgtctacgaggtattaggaagttaangacgaaataacaattatattatgactaaacctctaggtaggaagggactaagtacgttccacctatccgtacccgaagggtaacctaacttacccgaaagacctaacgtctagttactactttacgaaagtcgggactacgtccgtaggaacgacgcgttagggaacgggaccgtaaccggacgttagttaaacttaagtttaccggttagggggtaggggaaggtaaacgggggtagggtaaacggggtttaagggtttaaccggggtaaacggggtttaacggggggttttacgggggtaccggggggggttcccggtaaaacccgggggggg

SEQ ID NO: 267227 - DNA, 782 bp, Homo sapiens
  misc_feature: GYAE6OF01C0S8P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctgggtggagtcgtgggggaggtcgttggtccaggccggttgggggggtccctggacgtactctccgtgtcgcacgtcctgtggtacttcctaccttcaagttatttagtgtactatcgacctacggttcggggtcccgaccgacggtccgtaccggaacgggggtaaacgggaccgttaagggaattacgttcggttacctacggtaaagggttaagtttaaacggtaaagttaaagtcggaaaccgtaaaattaaaacgtagtttaaatttaaatttaacgtacgtaacctaaaacgttcggttaggtaacgggtaaaacgggtcctaaaggttacctttacccaaaccgtacgttaccctaccgggaaaggtaaccttaaacgttacccgaaaaacgtaccgacgtaccttagtaacgttacctttaacgaaacggttcgggacctaacgtccgtaaggaacggtacgcgttaaggaccggtacggaccgtgttaacgtaattacggttacggtagggtagggacggtaggtacgacgggttaagtagggtaacggttgggttacgggcgggtcgtaacgggg

SEQ ID NO: 267228 - DNA, 836 bp, Homo sapiens
  misc_feature: GYAE6OF01DRPGV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgtcttatttttaaaggtgtccagtgtgaggtgcagctggtggagtcgtgggggagcttggtccaggccgtgggggtccctgagactctcctgtgcagcctctggattccaccttcagttatttatgacttatcgactacgtcggggttcccgcccgaacgggcctacccggaaggggggaaacggggtaccgttaggggtaaattacgttacggtttaccgtacgttaagggttaaatttaaggaaaacgtttaaagtggaaccggtaaaattaaaactaatttaaattaagttttaatacggtaactaaaccgtttcgttaggttaagggaaacgggtaccgtaagtaactttacccaaacccgtacttacccgttaaccgaaacggggtaacctaaacgtttaaacccgaaacgtaaacccgaccgttaccgttacggttaacctttaaccgtttaaccgtaaaaggttccggggtactaaaccggtccgttaaggaacgtacggacccggttaggaaccggggttacgaaccgggttacgttacggttaaactttacgttaacgggttagggtacggggaagggtaacggggaacggttaccggtaaagggttacgggtaaaacgggtttgggggtttaaccgggtgggggtaccggtaaacccgggggg

SEQ ID NO: 267229 - DNA, 607 bp, Homo sapiens
  misc_feature: GYAE6OF01DU7J5.28.57.F02.1.454.CMB.1.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (589)..(589): a, c, t, g, unknown or other
  misc_feature (589)..(589): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtcgggtccgccaggctaccgaggggaaggactaggaatatgtctacgaggttattagaagtaatgacgtaaataanaatatattangacaaactcgtagtaggaaggcagtattcacctactctaccgagggactaactaccgaaanacgacgtntagttatccgttaacaaagtcgggacagtccgaggagtacgcgttaggaacggcgaacggccgttataagttagttagtgggttagggaggtaacgggaaggagggttaaagtttaggggaaacggttagggggttcggngggggtccgtaacggggg

SEQ ID NO: 267230 - DNA, 718 bp, Homo sapiens
  misc_feature: GYAE6OF01BFCQX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccaggccgtggggggtcccctgagactctccgtgtgcagcctcgtggattcacctttcagttatttatgctatgcctacgtcgggtcccgccgaggcctacccgaaggggaacgggacgtggaatatgtctacgaggttaattaggaaagttatgacgaaataacgattaataattatacgactaaactcgttagtaggaagggtcgaagtactttaccgaacctacgttaccgtaccggaacgggtaaactaaacctttaacccgaaaacggaaacccaaccggttacttacgtttaacctttaccgtttaaaccaaagggtacgggtaacaaccggtcccgtaggaacggtaacggtcgtagggaacggtacccggaacggtccgttagtacgtttaagttaacggtgggtaaggggaagggtagggtaacgggtacgggtaaaggttcggggaaacggttagggggtttcgggagggggtccggtaaccggggg

SEQ ID NO: 267231 - DNA, 743 bp, Homo sapiens
  misc_feature: GYAE6OF01BL8BN.28.57.F02.1.454.CMB.1.raw
  modified_base (436)..(436): a, c, t, g, unknown or other
  misc_feature (436)..(436): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggttttccttgttgtcttagttttaaaggtgtccagtgtgaggtgcagcgtggtgggacgtggtgggggaggtcgttggtcccgaggtccggtcgggggggtccctggacgtaccttcctccgtgtcgccgacgtcccgtcgtggtacttccacctttcgtagttatttagtgtacttagtcgaccgtacgttcggggtccccgacgtaggccgtacccgggagggaacggtcgtaggtaatagtgtcgtagtaaggtaataagtaagtatagacgtaaataanattaatattacgtgaactaaacgtgtaggtaggaaacggtctaagtacttaccgtacctacgtccgtaacggacggtaaactaaccgttaaccgaaacggaacctacgtacgtacgttaactaacgttaacgaagtaccgggactaaccggacgttaggaacgtacgtacggagtacggacctacgggtaccttaagttagttacgttaacggtgggtaagggaacggtacgggtaggtaaccgggttaaagttacggggaaccggggtttaaggggtccggggtaacgggcccggggtaaacgggg

SEQ ID NO: 267232 - DNA, 736 bp, Homo sapiens
  misc_feature: GYAE6OF01BNAHG.28.57.F02.1.454.CMB.1.raw
  modified_base (322)..(322): a, c, t, g, unknown or other
  misc_feature (322)..(322): n is a, c, g, or t
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccaggccgtgggggtccctgacgactctcctgtcgcacgcctcgtggtacttcctacctttcgagttatttagtcgtctagtcgctacgtcggggtcccnccgaggcctaccggaggggaacggacgtaggaatagtgtctacgtaaggttattaagaagttaanggtaacgtaaataaactaattattaattatacgaactaaactcgttaggtaacggaaggctaagtacttaccaaccgtacttccgaaccgtaagggaacctaacgttaccaaagaaccgtcgtacttgttaacttccttaacgaaggttccgggactaccggtaccgtaggaacggtacgtacgtaacggaacgggaccgtaccgggttagttaaggttaaactttacggttaacggtggggtaagggggaggtaaaggggtacgggtaacgggttaaaggggtttacgggtaaacccggggtttaggggggttacggggtacccggggggtaccggtaaaccgggggg

SEQ ID NO: 267233 - DNA, 778 bp, Homo sapiens
  misc_feature: GYAE6OF01EJIRG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagtcgttggtccagccgtggggggtccctgacgactctcctgtgcacgcctctggactttccaccttctagttattttatgtctagtgctacgttcgggtccccgccgacgggtccgtaccggaggggaacgggtacgtggaattacgtgtctacggtaaggttaattaaggaaagttaagtagaacgtaaataaactattaattaattatagtacctaaaactcgttaggtaacgggaaacgggtactaacgtacgtttaccaacctaacctccgtaacccggaaagggtaaacctaaacgttaaccaaaacggaaccgtaaccgtaccttacggttaacttaccttaaacgttaacgtccgggtaactaccggaccgttggaacggtaccgtcggtaacgggtaacggtaacccggtaccggtacgttaagttaccgttaaagtttaccgggttagggttacgggggaaggtaacgggggtaacggtaaggggtttaacggttaggggtaaaccgggtttagggggttacggggtaccgggggtacccgggtaaacgggggg

SEQ ID NO: 267234 - DNA, 742 bp, Homo sapiens
  misc_feature: GYAE6OF01DKE0K.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgcttatttttaaaggtgtccagtgtgaggtgcagctggtggagtcgtgggggagtcgttggtccgaggcccggttggggggttcccctggacgtacctcctccgtgtcgccacgtcccttcgtaggacttcctaccttctaagtttattttatgtcttagtcgctacggtcgggtcccgccgacggtcctaccggaagggggaacggacgtaggaatgtcgtcgtacgaggttaataagtaagtaagtgaacgtaaaacttaaacaattaatttaattaatacgtaactaaacttcgtaggtaggaacgggactaacgtaacttaccaaccgtaacttcgtaacccggaagggtaaacctaaacgttaaccgaaagtaaccgacgtaccttagtacttacttaacgaaaggttcggaccgaacgtaccgtaggaccgtagacgtaggaacggtaccgacggttacttaggttaatttacgtagggttacgggtagggaacgggtaagggacggttaacgggtaaagtttacggggtaaacggtttagggggttacggggacggggtcggtaaacggggg

SEQ ID NO: 267235 - DNA, 638 bp, Homo sapiens
  misc_feature: GYAE6OF01D6PIB.28.57.F02.1.454.CMB.1.raw
  modified_base (175)..(175): a, c, t, g, unknown or other
  misc_feature (175)..(175): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggntccagtgtgaggtgcagctggtggagtctgggggagcttggtccagccgtggggggtccctgagactctcctgtgcagtcctctggattccaccttcagttatttatgtctatcgctacgtgggtccgcaggcctaccggaggggaacggacctaggaatagtgtcctagtacggttattaacgaagtaatagacgtaaataacaagttaatattaatcgaactaaactcgtaggtaggaaaggtactaagtacttacgaaccctagtacctaccggaaaggaacctaacgttaccaaaggtaaccaccgtacttaggtacttacttaacaaaggttcgggactaacggtcctaggagtaccgcgtaggacgacgtcgcttagtattaacgtcgtgggtagggaggaacggacggtaggtaacgttacggaacggtttgggtgggtaccgggtcgaaacgggg

SEQ ID NO: 267236 - DNA, 725 bp, Homo sapiens
  misc_feature: GYAE6OF01ETSJI.28.57.F02.1.454.CMB.1.raw
  modified_base (602)..(602): a, c, t, g, unknown or other
  misc_feature (602)..(602): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaggtgtccagtgtgaggtgcagcgtggtggagtcgtgggggaggtcgttggtccaggtccggtcgggggggtcccctaggacgtaccttccgtccgtggtcgcgacggtccttcgtggtactttcctaccttacgtagttatttatgcttagtcgtccgtaccggttcgggtcccgccgacggtccgtacccggagggggaacgggtacgtaggtaattacgtcgtaccgtaggtaaggttaagtttaaaggtaaagttaacgtacggtaacgtaaaactaaacttaattaattaattagtacgtaactaaacgtacgtaggtaacggtaacgggtacaacggttaacctaccacccgttaactaccgtacggaacggtaacctaacgtaaccaaacgacctacgtacgttatacttacagtaaacgnggtacacgtccgtagcggatcgaggacgacgcgtactagttactagttacggtggtaggaggtaggcgtaagggtaggttaagggtaacgggttaggggtcggccgggggtcggtaaccgggg

SEQ ID NO: 267237 - DNA, 792 bp, Homo sapiens
  misc_feature: GYAE6OF01DLI42.28.57.F02.1.454.CMB.1.raw
  modified_base (721)..(721): a, c, t, g, unknown or other
  misc_feature (721)..(721): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaatttttaaaggtgtccagtgtgaggtgcagcgtggtggagtcggtgggggagcgttggtccaggtcccggtggggggttccctggacgtaccttcctccgtggtgccacgtccgttcgtaggtactttccctacctttctagtttatttatcgtctagtcgaccgtacggtcgggtcccgacgcggtccgtaccgggaagggggtaaacggtacgtaagggtaaacttagttcgttaccgtaacggtaaggttaagtttaaaggtaaagttaagtacggaaacgttaaaacttaaactaagtttaaatttaaagtttaacgtaacgtaaacccgtaaaacgtttcgttaaggggtaacggtaaacgggtactaaacgttaccttaacccaaccgttacctaccggttaacccggaaacggtaacctaaacgttacccgaaaagtaacccgtcgttacttacgttacttaccttaaacggaaggtcggaacctacggtacgtagacgtacgacgtacggaacggacgtacggtctttaagtagtacgttacggnggtaagggagtagggaacgtacggtaaggttacgggacgggttaggggtcgggaaccgggtcggtacgggg

SEQ ID NO: 267238 - DNA, 606 bp, Homo sapiens
  misc_feature: GYAE6OF01BX8T6.28.57.F02.1.454.CMB.1.raw
  modified_base (513)..(513): a, c, t, g, unknown or other
  misc_feature (513)..(513): n is a, c, g, or t
  modified_base (530)..(530): a, c, t, g, unknown or other
  misc_feature (530)..(530): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtctgggggagcttggtccagccgtggggggtccctgagactctcctgtgcagcctctggattcaccttcagttatttatgctatgcacgtgggtccgccaggctccgagggaaggactggaatagtgtctcgaggtattagaagtatgacgaaatacatatattatgactaaactcgtagtaggaagggacagtacttacaccctatcctaccgaaggggtaactaacttaccgaaacgaaccacgtacttagttactaccgtttacaaagtcgggtacaacgtcgtgaagtggactggaaggcacggtntagtattacgttaacgngggttaggggaagtagggaggtacggttaaggtacgggtaacggttaggggttaggggtcggggccggtacggggg

SEQ ID NO: 267239 - DNA, 535 bp, Homo sapiens
  misc_feature: GYAE6OF01A4TUP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtcccctgagactctcctgtgcagcctctggattcaccttcagtatttatgctatgcactgggtccgccaggctccgagggaagggctggaatatgtctcaggtattagaagtaatgcgaataacatatattatgacaaactctgtgaagggcagtattcacatctccagggacaattaccaagaacacgctgtactcttacaatgggacagcctgagagctgaggacgacggctgtatagttacgtggtagggagagggagaggtattagggacgttaggggttcggtggggtcgtacgggg

SEQ ID NO: 267240 - DNA, 724 bp, Homo sapiens
  misc_feature: GYAE6OF01EX3UQ.28.57.F02.1.454.CMB.1.raw
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgacgactcctcctgtgcagcctctggattcaccttcagttatttatgctatgcacgtgggtccnccgaggcctaccgaggggacggtactggaatagtgtctacgtaggtattaagaagtaatcgacgtaaataaacgattaatattaactagactaaactcgtaggtaggaacgggtacaagtacttaccgaacctacgtccgttaccgaacgggtaaacctaaagttacccaaacggaaacctaccgtacctttacggtaacttaccgtttaacgaaaacgttcggggacctaacggtacccgttagggaacggtacggtcgttaacgggaacgggaacccgtaaccggggtcttacggtttaaacgttaacgtttacgggtagggttagggggaacgggtagggaacggggtaacgggttaaagggttacggggttaaacgggttagggggtttacggggtacggggccgggtaaaccggggg

SEQ ID NO: 267241 - DNA, 841 bp, Homo sapiens
  misc_feature: GYAE6OF01C4H2H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggtgtccagtgtgaggtgcagcgtggtggagtcggtgggggaggtcgttggtccgaggccggtcggggggttccctggacgtacctccgtccgtggtgccacgtcctcgtggtacttcctacctttcgtagttatttatgcttagtcgacgtacggtcgggtccccgaccgacggtaccgtaccggaaggggtaaacgggtacgtaagggtaaattacgttagtaccgtacggtaaggttaagttaaggtaaaagttaacgtagtaacgtaaaagtaaactaattaaagtttaagtttactacggtaacctaaaaacgttcggtaaggtaacgggaaacggtacgtaacgtaccgtttaccaaaccgtacgtaccgtaaccggaacgggtaaacctaaacgttaaacccgaaaagtaacccgtaaccggtacttacggttaacccttacgttaacgtaaacggttcgggaacgtaccggtacgtaggtaacggtaacgtccggtaagggtaaccggaccgtaaaccggtcgttaacgttaaagtttaacgtacggttagggtaaggggaacggtaaggggaaccggttaagggtaaacggttaacggggttaaacgggttagggggtttaccggggacggggtaacgggtaaacccggggg

SEQ ID NO: 267242 - DNA, 701 bp, Homo sapiens
  misc_feature: GYAE6OF01DM749.28.57.F02.1.454.CMB.1.raw
  modified_base (174)..(174): a, c, t, g, unknown or other
  misc_feature (174)..(174): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagctgggttttccttgttgctatttttaaaggngtccagtgtgaggtgcagctggtggagtcgtgggggagcgttggtccagccgtggggggtccctggagactctcctgtgcagcctctggattccacttcagttacttatgctatgcacgtcgggtccgaccgacggctccgagggaagggtactaggaatatgtctgagtataggaatatgacgtaaataacgataataattagtacgaactaaacgttctaggtacggaagggtacctagtaacgttacccaacgtaacttccgtaacgaagggtaactaaacgttaaccgaaacgaacgtacgcgttaagttacttaccgttaacaaagttcgggactaacggtccgtaaggacggtacgacgttacgaaacgggtaccgaacggtaccgttaggttaaacgttaacgttaccggttaggggttaaggggaagggttaaacgggaacgggttaacgggtaaatttaacgggggtaaacggtttaagggggtttcggggtaaccgggggtacggtaaaccgggggg

SEQ ID NO: 267243 - DNA, 823 bp, Homo sapiens
  misc_feature: GYAE6OF01D01U8.28.57.F02.1.454.CMB.1.raw
  modified_base (481)..(481): a, c, t, g, unknown or other
  misc_feature (481)..(481): n is a, c, g, or t
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctggagtcgttgggtttttccttggttgtactttaagttttttaaagggtgttacctaggttggttaggagggtgccgaggtcgttgggtgggtacgttcgggtggggggacggtcgtttcgggtcccgaggtcccgggttcggggggtccctggacgtccttccgtccgttggcgaccgagtccctgtggtacttcctaccttgtaagtttatttgtcgtactagtcgtccgtacggttccggggccccgaccggtaaggtcccgtaaccggggaaggggaacgggtacttaggtaaattcgtcgttacctaggtaaaggttaataaaggtaagttaanacggaataaaactaactagtattataacgtnaacctaactcgtaaggacgacggactacgtactaccctacgtactaccgttaacgaaggtaaccttaaacgtacgaaacgtaacgtcccgtaattacgtacttacgtaacggtaaaggtccggtaaacgtcgtaccggtaagggacggtaaccgaggtacccggtaaaggccccggaaaggttcttaaggttaaaccgttacgttagggtaagggacggggtaaggtacgggtaacgggtaacgggtttaaacgggtcgggttaaacggggtttagggggtttacggggaccgggccggggttaaaccggg

SEQ ID NO: 267244 - DNA, 698 bp, Homo sapiens
  misc_feature: GYAE6OF01ECRSY.28.57.F02.1.454.CMB.1.raw
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
tcagagtacgctatcacgaccggtgctcgatttagctcgatatagttgggtctggggagaggagcccccgccctgggtttcccaggtgttctcatttggtgatcagcactgcacacagaagagtcatgacgggagttttgggctgagcttgggtttttccttgttgcttatttttaaaggtgtccagtgtgaggtgcagctggtggagtcggtgggggaggcttgggtccaggcccgtggggggtcccctggacgactctcctgtgcagcctcgtggtacttccacctttnagttatttatgtctagtgcacgtcgggtccgccgagggcctaccggaggggaacgggactaggaatactgtctacgtaggtattagaagtagtgacgaaataacattaatattangactaactcgttagaggtaacgggatacgtacttaccaacctattaccgtaacggtaacggaaacttaacttaacccgaaagaaccacgtcttagtactaccttaagaaggtcggacgtacgtcctaggacgtacggtactcgggaaggaccgtagggtaacgttacggtaatttaacggtttacggtacgggttaggggtaaagggacgggttaacgggtacgggttaaacgttttacggggaaacgggtttaggggggtttaccggtcggggggaaccggttaacggggg

SEQ ID NO: 267245 - DNA, 745 bp, Homo sapiens
  misc_feature: GYAE6OF01CVU0T.28.57.F02.1.454.CMB.1.raw
  modified_base (449)..(449): a, c, t, g, unknown or other
  misc_feature (449)..(449): n is a, c, g, or t
  modified_base (641)..(641): a, c, t, g, unknown or other
  misc_feature (641)..(641): n is a, c, g, or t
  modified_base (662)..(662): a, c, t, g, unknown or other
  misc_feature (662)..(662): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgtcttatttttaaaggtgtccagtgtgaggtgcagctggtggagtcgtgggggagcgttggtccagccgtcggggggtccctgacgactctccgtgtgcacgcctcgtggtacttccgacctttcagttatttagtgtactatcgactacgtcgggtcccgcccgaggtcctaccggaaggggaacgggtaccgtagggtaaattagttcggttaccttacggtaagggttaagttaacggaaagttaagtcggaacgtaaaagtaaactaattaattaagtttanacgtaacctaaacttcgtaggtaggaaacgggctaaggtactttacccaaccgttattcccgtaccggaaacgggtaaactaaccgttaacccgaaaggtaaccctacggtcctttaagtaccttacgttaacgaaaggttccgggactaacggccgtaggaacgacgtcgtaagacggtaccgtaacggtnttaagtacgttaggttacggngggtagggtaacggaggtacgggtaggttaacggttacgggtaaacggttagggggttcgggtaccgggggacgtaacggggg

SEQ ID NO: 267246 - DNA, 896 bp, Homo sapiens
  misc_feature: GYAE6OF01EKMQY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcttgggttttccttgttgcttaagttttaaaggtcgtcagtgtgaggtgcagcgtggtggagtcgtgggggagtcgttggtccaggtccggtcggggggtccctaggacgtaccttcgtccgtggtcgccagtccctcgtggtacttcctacctttctaagttattttagtcgtacttaagtcgtaccgtaccggttcggggttccccgaccggtacggtcccgttaacccgggaaggggtaaacgggtaccgtaagggtaaacgtttacgttcggttaccgttaacgtaaaggtttaaagttaaaggtaaaagttaagtaacggtaacgtaaaataactaaattaagttaattaagtacaaaccgtaaacttcgtaggtaacggaaacggtacgtaagttaaccttaacccaaccgtacttacccgtaaccggaaacggtaaaccttaaaccgttaaccgaaaacgaaaccgtaccgttaccgttaagttaacttaaccgtaaacgttaacgggtaccggacgtaacggtacctagggaacgtaaaccgggtcgtaaagggtaaccggtaaccgtaccggtacgtttaaacggtttacttaaacggttttaccgggtagggttaacggggtaagggtaaaaccggggtacgggttaaaacccggggttaaaggggtttaaccggggttaacggggttttaaagggggttcgggggttaaaccgggggtaaccgggttaaacccgggggg

SEQ ID NO: 267247 - DNA, 170 bp, Homo sapiens; identical to SEQ ID NO: 266815
  misc_feature: GYAE6OF01BXVXI.28.57.F02.1.454.CMB.1.raw
  modified_base (165)..(170): a, c, t, g, unknown or other
  misc_feature (165)..(170): n is a, c, g, or t

SEQ ID NO: 267248 - DNA, 774 bp, Homo sapiens
  misc_feature: GYAE6OF01DCWXX.28.57.F02.1.454.CMB.1.raw
  modified_base (321)..(321): a, c, t, g, unknown or other
  misc_feature (321)..(321): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagtcttgggtttccttgttgcttaattttaaaggtgtccagtgtgaggtgcgagcgtgggtggagtcggtgggggacggtcgttcggccgtaggccggttcgggggggtcccctaggaacgtcctccgtccgtggtcgcacgtccgtcgtggtacttcgtacccttgtaagtttattntgtctatgccgaccggttcgggtcccgaccggacgtccgtaccgggaaaggggtaacggtaccgtaaggttaaattacgtacggtaccttaggtaaaggttaagttaaagaaaacgggttaactaacggaaccgtaaaataaactaattaaatttacgtaacgtacgtaaaccttaaacgttcggtaaggtaacgggtaaggactaagtacctacctacacgtacctaacccggaggtaaacctaagtaacccgtaaacggaacctacgtacgtacgtacttaaccgtaacgtaacggtacgggctaacgacggtagacgtagccgtaggaccggacgccgttagaccgttagtaacgttacggtagggtaacgggaggaccgggtaggtaacggtaaagggttacgggtaacgggttagggggtcgggtaacggggtaccgggtaaccgggg

SEQ ID NO: 267249 - DNA, 636 bp, Homo sapiens
  misc_feature: GYAE6OF01BVRIY.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcgtggtttcgtgttaggcgtacttttaaaggtgtccagtgtgaggtgcagctggtggagtctgggggagcttggccagcctggggggtccctgagactctcctgtgcagcctctggattcaccttcagtattatgctatcgcactggtccgccaggctccgagggaaggctggaatagtgtactgtaggtatttagaagtaatggactaaatacaatatagttatgactaaactctgtgaaagggcagtacttacactagtctaccgaggtaacacttacaagaactacgtctagtatctttacgaaagttgggactacgccgtaggaggaacgcgttcggaaggaccgtaacgggtccttaggttaaacgttacgtttaccggtcgggttaaggggaacggtaacgggaaggtaccgggtaaaggttttaccgggaaacgggtttacggggtttaacggggttccgggggttacccggtaaacggggggg

SEQ ID NO: 267250 - DNA, 867 bp, Homo sapiens
  misc_feature: GYAE6OF01EHQLT.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatgacggtagtttgggctggagtcgttgggttttccttgttgtcttaagtttttaaaggtgtccagtgtgaggtgcagtcgtgggtggtaggttcggtgggggtaggtcgttggtcctacggtcccggttcggggggtccctggacgtaccttccgtccgtgtcgcgtacgtccctgtggtacttcctaccttcgtaagttatttagtcgtctagtcggaccgtacggtccgggtcccgaccggtaggtccccgtaacgggaacggggtaaacggggggtactaaggtaaattcgttacgttaccgtaggttaaaggttaaagttaaaggtaaagttaacgtacgtaaaccgtaaaataacgtaatttaactttaagttaactaacgtaacttaaacgttcgtaaggtaggaacggtacgtaagttacttaaccgtactaccgttacgttaacccgtaacggtaaacggtaacccgttaaacgttaacgaaaccgtaaccgtaccgttaagtttaaccgtaactttaccgttaaacggtacgtacggtaaccgtaccgtaaccggtaggaaccggtacgttacggtaaccgggtaacgtaccggtaacggtacgttacggttaaagtttaccggttaggtacgggggttaaggacggggtaaggtaacccgggttaagggttaacgggttaacccgggttaagggtttcgggggttaaaccgggtccggggtaaaccgggg

SEQ ID NO: 267251 - DNA, 738 bp, Homo sapiens
  misc_feature: GYAE6OF01EU68G.28.57.F02.1.454.CMB.1.raw
  modified_base (341)..(341): a, c, t, g, unknown or other
  misc_feature (341)..(341): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggaggtcgttgggtccaggcccggttgggggggttcccctggacgtaccttccttccgtgtcgccgacgcccttcgtggacttccaccctttcagttattttactgcttatgcctacgtcggggtcccnccgaggcctaccggaaggggaacgggtacgtagggaacttagtcgtactacggaaggttaagttaaggtaaagtaagtggaaccgtaaaataactaattaatttaacgttaatacgacctaaaacttcgtaggttaacggaaagggtactaagtacttacccgaacctactaccgtacgaacgggtaactaaaccttaccgaaacgtaaccacgtacttacgttattaccgttacaaacgttgggaccgtagacccgtaggacgtacgtcgtacgacggacgtacggtacgttagttacttagttacgtagggtaggggaacggagggaacggtagggttaacggttagggttaaacgggttacggggtttcggggacggggtcgggtaaccggggg

SEQ ID NO: 267252 - DNA, 718 bp, Homo sapiens
  misc_feature: GYAE6OF01EXOQC.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttcttgttgctatttttaaaggtgtccagtgtgaggtgcagctggtggagtcgtgggggaggcttggtccagcccgtggggggtccctgagactctcctgtgcagcctcgtggattcaccttcagttatttatgctatgcacgtggtccgcaggctccgaggggaggactggaatatgtctcgaggtattagaagtatgacgaataactaatattaattatagactaaaacttctaggtaggaaagggcaaggtacttaccgtaaccctaacttccgtaacccgaaggggtaaacctaaactttacccgaaaacggaaccctaaccggtccttagttaaactttcccttaagtaaaacgttcggggaacacggtacccgtagggaacgtacgtcggtaacgggaagggtaacccggaccgggtacggttagtttaacgttaaacgttttaacggttaggggtaggggaaggtaagggggtaacggtaacggggtttaaaggtttaacgggggtaacggtttaaaggggggtttcggggttacggggggacccggttaaacgggggg

SEQ ID NO: 267253 - DNA, 907 bp, Homo sapiens
  misc_feature: GYAE6OF01CZDO8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtctttaagtttttaaaggcgtccagtgtggaggtgcagcgtgggtggagtcggtgggggaggtcgttcgggtcccgcggtccggggtccggggtccagacgtccgtcctcgtgtcgacgacgtcctcgtagttaccttcctaccttacgtagtttattacgtcgtattacgtccgaccgttaccggtcccgggtcccgaccggtacggtcccggtaaccggggaaagggggtaacggttacggtaaggtaagttcggttacgttccgtaaacgggttaggttttaaaaggtaacggtaaaagttaacggtacggtaaaccgttaaaaacttaaacgttaagtttaaacgttttaaagttttaacgaaccggtaaaacccctttaaaccgtttgggtttaagggtaaacggggaacgtaacgttaacgttaaccgttaacccccgtaaccggtttaaccgtaccccgtaaaccggggtaaacggttaacccttaaaaccggttaaaccggaaacccgaaccgtacccgtttacgttaaccgtttaacgttaccgtttaaacgaggtaccggaccgtaaccgtacggaggacgtaggtaacggttacggacgtacccggtaggttacgttaactacgtttaacgtcgggtagggtaagggtacgggtaaaggtacggggtaaggtttaaacggggtcgggttaacgggttagggggttacccgggcggggaacggtacccgggg

SEQ ID NO: 267254 - DNA, 693 bp, Homo sapiens
  misc_feature: GYAE6OF01DJK96.28.57.F02.1.454.CMB.1.raw
  modified_base (124)..(124): a, c, t, g, unknown or other
  misc_feature (124)..(124): n is a, c, g, or t
  modified_base (270)..(270): a, c, t, g, unknown or other
  misc_feature (270)..(270): n is a, c, g, or t
  modified_base (689)..(689): a, c, t, g, unknown or other
  misc_feature (689)..(689): n is a, c, g, or t
tcagagtacgctatcacgaccggtgctcgatttagctcgatatagttgggtttggggggtccctgagactctcctgtgcagcctctggattcaccttcagtatttatgctatgcactgggtccnccaggctccagggaaggactggaatatgtctcaggtattagaagtaatgacgaataacatatattatgacaaactctgtgaagggcagatcacatctcaggacataccaagacacgctagtatcttacaagtggacagcctagagngcgtgaggacgacggctagtattatacgtggtggaagagaggacgtaagtggaacgtagggtggtacgggaccgagggacgccgtaggacctaccgtctccgacgaccgtccctacccgaaccgtacgggacccctacgttcccggtacccttccccgtcggtccccgtaccccgtcggtcccctaccgacgggaccgtaccgaccccgtacgaacggtaccgacctaaccggccgggaccggtcccccggtagggcccgttaccggtacccggtacgggtaaccgtaaacccggtaccgttttaacccgttacccgtaacgtttacggttacggttaaccttttcgggaacggttaccggggtccggggtacgttaccggggacggtaacgggtcccgaacgtagtaacggcgtacgngtac

SEQ ID NO: 267255 - DNA, 672 bp, Homo sapiens
  misc_feature: GYAE6OF01DEETP.28.57.F02.1.454.CMB.1.raw
  modified_base (190)..(190): a, c, t, g, unknown or other
  misc_feature (190)..(190): n is a, c, g, or t
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (562)..(562): a, c, t, g, unknown or other
  misc_feature (562)..(562): n is a, c, g, or t
  modified_base (585)..(585): a, c, t, g, unknown or other
  misc_feature (585)..(585): n is a, c, g, or t
  modified_base (617)..(617): a, c, t, g, unknown or other
  misc_feature (617)..(617): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcagtggacggtagtttggggctggagtcggtggtttcgtgtaggcgtatttaaggtgtcagtgtgnggtncngntggtagcgtgnggggcncttggccngtccggtcggggtccagagtctctcgtgacgcncgcctgtagtacttcctaccttgtattattgtgacttgcgccgcggtccgggtacccacgcgccgtacgggaaggggaacgtacgtaggttaactgtcgtacctaagtaggttaattaaggaaccgtttagacgtaaacgaaacttaatattaggttaaaccttgaacgtaacctagtaggtgggaaacggttggaacctgtaccgttaacaaccgtcgttacgaccgggttaacgaacgttaccaaccgaacggacctaccggtatcggtacttaaccgtagaacgtcgacgtcgacgtaacggngtagacgacggtacgtcgtagtnttaagtacggttagtagggaggtaggtacggnggtaacggtaggtaagggttacgggtacgggtgggtacgggtcggtacggacggg

SEQ ID NO: 267256 - DNA, 775 bp, Homo sapiens
  misc_feature: GYAE6OF01EMMLJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtgggggaggcttggtccaggccggtggggggtccctgacgactcctcctgtgcacgcctgtgtacttccaccttctagttatttatgtactatcgccgtaccgtcgggtcccgaccgtacggtccgtaccgggaagggggaagggtacgtaggtaatacttcggtacttacgtaaggttaagttaaggaaacgttaagtagaaccgtaaaattaaactaattaattaagttagtaacgtaacttaaaaccgtcgttaaggtaagggaaacgggtacgtaacgttaacgttacccaacctactacccgtaaccggaaacggtaaaccttaaacgtaacccgaaacaaccgtaacccgttacttacgttaacttaccgttaaacgtaaacggtccgggacgtaacggtaccgtaaggaggtaaacggtcgtaacgggaacggtaccgtacggtattaacgttaattacgggttacggtaggggtagggaacggtaagggacggtaagggtaacgggttaacgggtaacgggtttagggggtcggggtaccggggacggtaacccggggg

SEQ ID NO: 267257 - DNA, 720 bp, Homo sapiens
  misc_feature: GYAE6OF01E2V74.28.57.F02.1.454.CMB.1.raw
  modified_base (324)..(324): a, c, t, g, unknown or other
  misc_feature (324)..(324): n is a, c, g, or t
  modified_base (535)..(535): a, c, t, g, unknown or other
  misc_feature (535)..(535): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtggtggaggtcgtgggggaggtcgttggtcccaggtcccggttcgggggggtccctggacgtaccgttcctccgttgtgccgacggtccttcgtggtacttccctaccctttctaagttattttangtctatgccacgttcgggtcccaccgacggcctaccggaaggggaacgggtaccgtaggaacttatcgtacctagtaggttaataaggaagtaatgaacgaaataacattattaatagtacgaactaaacgtcgtaggtaggaacggactagtactaccgaacctactccgtaacccgaggtaaacctaagttacccaaaagaccgacgtntacgttactcgtaactaagcggcagtacctaggaaccgtagcgttaaaggacggacgtacggtcttaagttaacgtttaacggtacgttggggtaaggggaaacggtaggggaacggttaacgggttaaggttaacgggttaacgggttaggggttacgggttcgggggaccggtaaccgggggg

SEQ ID NO: 267258 - DNA, 904 bp, Homo sapiens
  misc_feature: GYAE6OF01E445T.28.57.F02.1.454.CMB.1.raw
tcagagtacgctatcacgaccggtgctcgatttagctcgatatagtggggtctgggagaggacgcccccgccctagggtttcccaggtgttctcatttggtgatccagcactgcacacagaagagtcatgacggagtttggctgagtcgtgggttttccttgttgctatttttaaaggtgtccagtgtgaggtgcagctggtggagtcgtgggggaggtcgttgggtccgaggccggtggggggtccctggcgacgtcctccgtgtgcacgtcccttcgtggacttccgtaccctttgtaacggtttattttacgtggtaccttaacgtcgtcctaaccggttccggggttaccccgacccggtacggggtcctacccgggaaacgggggtaaacggggtacccgtaaggggtaaactttacggttacgttaccgttaccggtaagggtttaagtttaaaggtaaaaggttaagttaacggaaccggttaaaaactaaacgtaaagtttaacgtttaaacgttaacgtacggaaccccttaaaaccgttcgttaagggtaccgggaaacggggtaccgtaacgggttaaccgttaccccgaaacccgtaccgttaacccggtaccccggtaaaagggttaaaccctaaaccggtttaacccgaaaaaccggtaaacccggtaccggtaccgttacgttaaccgtttaccgttaacgaaacggttcgggaacgtaccggtaccgtaggaacgtacgtacggtaggaaccggtaacggacggttaccgtagtttaacgttacgttacggttcgggtaacgggagggttaacgggacgggtaacggggttaacgggttaacggggtaacggttagggggttcggtcgggggtaccggtaccgggggg

SEQ ID NO: 267259 - DNA, 784 bp, Homo sapiens
  misc_feature: GYAE6OF01CRYMU.28.57.F02.1.454.CMB.1.raw
  modified_base (176)..(176): a, c, t, g, unknown or other
  misc_feature (176)..(176): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagcgtggtggagtcgtgggggaggcttgggtccaggccgtggggggtccctggagacctctcctgtgcagccctgtaggtattccacctttcagttattagtcgctatgctacgtcgggtcccgcgacggtcctaccggaagggggtaacggacgttaggtaatacgttgtacctacgtaaggttattaaggtaaagtaatcggaacgtaaacttaacgaatttaataatttagtactactaaacgttcgtaggtaggaagggctagtacttaccaccgtaacgttccgtaaccggaacgggtaacttaaaccgttacccgaaacggtaaccctaacggttaccttaggtacctttaccgtttaacgaacggttcgggacgtacgcggtaacgaggtacggtacgtagggaaccggtaacggtaccgggtaccttaggttaaaccgtttagttaaacggggtttcggtggggggtaaacggtaaacggggtaacggggttaacgggttaaaaccgggtttacgggggttaaaacgggttttagggggggtttacgggggttaccgggggtaaccccgggggtaaacgggggg

SEQ ID NO: 267260 - DNA, 873 bp, Homo sapiens
  misc_feature: GYAE6OF01AVG7L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttggggtttttccttgttgtcttaatttttaaaggtgtccaggtgtgaggtgcagcgtgggtggagtcggtgggggagtcgttcggtccaggccggttcggggggtcccctggacgtaccttcctccgtgtcgcctacgcccttgtggtacttcctaccgtttctagtttatttagtcgtacttagtcgccgtacggttcgggtacccgcggtacggtccgtaccggaaggggtaacgggacgttaaggtaattacgttcgttaccgttacggtaaggtttaattaaaggtaaagttacgtaagaaacgtaaataactaattaatttagttaatacgtaacctaaacgttcgttagggtaagggaacggtacgtaaagttcccgttaaccaacccgtacgttccccgtaacggggtaaaggtaaacccctttaacggttaaacccgaaaacgtacccggttaccgttacgtttacgttaccttaaccggttaaccggtaaaggttccgggacctaacggtcccgtaaggggaaccgttacggaccgggttaacgggaaacccggtcggtaaccgggttacgttttaaagttaccggtttaaaagtccgggtttaagggggacggggaaaggttaacggggaacgggttttacgggaaaacggtttttcgggggaaacgggggttttagggggtaccgggggtccgggaaacccggggttaacgggg

SEQ ID NO: 267261 - DNA, 726 bp, Homo sapiens
  misc_feature: GYAE6OF01B3AK1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttaatttttaaaggtgtccagtgtgaggtgcagctggtggagtcgtgggggaggcgttggtccagccgtggggggtccctggagacctctcctgtgcagcctctggattccaccttcaagttatttatgctatgctacgtcggggtcccgccacggcctaccggaaggggaacggggactagggaatatgttctcgtaaggttaattaaggaaagttaagtgaacgtaaaataaactaattaattaattaagtacgaactaaactgtaggtaggaaacgggtcaagtacttaccaaccctagtccctaccggaagggtaaacctaacgttaaccgaaaagaaccgtacgtcttagttaacttaccgttaactaaaggtcgggactaacgggtcctaaggaggtacgacggttagggaaccggtaacgaccgggtacgtttagtaacgttaacgttacggtaggggtaggggaacgggaaggggtaaggtaaccgggttaaaggttacggggtaaacgggtttagggggttacggggtacggggggtaacccggtaaccgggggg

SEQ ID NO: 267262 - DNA, 732 bp, Homo sapiens
  misc_feature: GYAE6OF01BT9ID.28.57.F02.1.454.CMB.1.raw
  modified_base (263)..(263): a, c, t, g, unknown or other
  misc_feature (263)..(263): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttaatttttaaaggtgtccagtgtgaggtgcagctggtggagtcgtgggggaggcgttggtccagccgtggggggtccctgagactctcctgtgcagcctntggattcaccttctagtatttatgtctatcgctacgtcgggtcccgccgaggcctccgaaggggaacgggactaggaatagtcgtcgtacgtaaggttagttaaggaagtaagtgacgtaaagtaaactataattaattagtacgtaactaaacgttcgtaggtaggaaacgggtactaacgttacttacctaaccctagttcccgtaacccggtaagggtaaacctaacttaaccgaaacgtaaccacgtaccttacgttaacttaccttaacgaaacggttcgggacctacgtacccgtaggaacggtacggtacgtacgggaacggtacgaccgggtacttaggttaacttaacggttttacggtacggggtaggggaagggtacggggaaaggtacgggttaaaggtttacgggttaaacgggtttagggggtttacggggtaccgggggaccggtaacgggggg

SEQ ID NO: 267263 - DNA, 676 bp, Homo sapiens
  misc_feature: GYAE6OF01CCGEA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggaggtcgttggtccagccgtcggggggtccctggacgactcctcctgtgcacgcctcgtggacttccacctttcagttatttatgtacttatcgctacggtcggggtcccgccgacgggcctccggaaggggaacgggtcgtaggtaatagtcgtcgtacgtaaggtattaaggaagtaagtggaacgtaaaattaaacaagttaattaatttaagtacgtaactaaaccttcgtaggtaggaaacgggtactaaggtacttacccgaaccgtactaccgtaccgaagggtaacctaacttacccgaaagtaaccacgtacgtagttacttaccgtacgtaagtcggacacgtcgtaggagtagacgtaggacgtacgacgtgtagttatagttacgtgggtagggaggacgggagtagggttaagtagggtaacggtttaggggtggcggggcgtaacgggg

SEQ ID NO: 267264 - DNA, 821 bp, Homo sapiens
  misc_feature: GYAE6OF01CINHD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgcttagtttttaaaggtgtccagtgtgaggtgcagctggtggagtcgtgggggagtcgttggtccaggcccggttggggggtccctggacgtacctcctccgtggtcgccgacgccttcgtggtactttccacctttcgaagtttaatttagtcgtccttagtcggacctaccggttccggggtaccccgccgacgggtcctacccgggaagggggtaaacgggtaccgttagggtaaagttacgttcgttccgtacgtaaggttaagttaaaggaagttaacgtggaaactaaaactaaacgtaattaagtttaattagacgtaacctaaacgttcgtagggtaggaacggtactaaggttaccttaccgacctaacgttccacggaacggtaactaacgttaaccgaagtaacctacgttaccgttacttacgttacccgttaacgaaacgggttcgggacctacgggtacccgtaggacggtacgacggttaggaaccggtacgtaccggttagttaaccgtttaagtttaaccgggttaggtcgggggtaacgggaaaggggtacgggtaaacccggttaaagggttaagggttaaccgggtaaaaggggttttgggggttaacgggggaaccggggtccgggtaacccggggg

SEQ ID NO: 267265 - DNA, 753 bp, Homo sapiens
  misc_feature: GYAE6OF01EX0VU.28.57.F02.1.454.CMB.1.raw
  modified_base (285)..(285): a, c, t, g, unknown or other
  misc_feature (285)..(285): n is a, c, g, or t
tcagagtacgctatcacgaccggtgctcgattttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctggagactctcctgtgcagcctgtggacttcaccttcagttatttangtctatgctacgttcggggtcccgccgaggccttaccggaagggggaacgggtaccgtaggaattacgtcgtctacgaggttaacttaggaaagtagtagacgtaaagtaactattaattattaacgtagaacctaaacgtcgttaggaggtaagggactaaggttacttccgtaacccgtacttcccgtacccggaacgggtaacctaaacgtttacccgaaaagtaaccacggttacttaacggttaacttaccgttaaacgtaacggtcggggacctaacggggtacccgttagggaacggtacggtacggttacgggtaaccgggtaaccgtaccgggtacgttacgggtttaaattaccgggtttaccgtggggttacggggaacggtgggaacggtacgggttaaacggttacgggtaacgggtttaggggttcgggtaaccgggggccgtaaaccgggggg

SEQ ID NO: 267266 - DNA, 552 bp, Homo sapiens
  misc_feature: GYAE6OF01EBW5D.28.57.F02.1.454.CMB.1.raw
  modified_base (252)..(252): a, c, t, g, unknown or other
  misc_feature (252)..(252): n is a, c, g, or t
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (429)..(429): a, c, t, g, unknown or other
  misc_feature (429)..(429): n is a, c, g, or t
  modified_base (466)..(466): a, c, t, g, unknown or other
  misc_feature (466)..(466): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggttcccaggtgttctcattggtgatcagcactgcacacagaagagtcatgacggagttgggctgagctgggtttcttgtgctattttaaaggtgtccagtgtgaggtgcagctggtggagtcgtgggggaggcttggtccagcctggggggtccctgagactctcctgtgcagcctntggattcaccttnagtattatgcttatgctctgggtaccgcaggctcgagggacggactggaactangtctnaggtaattagaagtaatggacaanaactanatattacngactaaactgtgtaaggaggaacngtatacaccaatctaccgagtacgaattaccaaaggaacaacnctagtacctattaccaaagtgggctaagccgtagganacgntggaggagacgtcagtagttactacgtaggtcggaggtggaagcggtaaagtgtaaacgtgggttacgtgggtcgaacgggg

SEQ ID NO: 267267 - DNA, 676 bp, Homo sapiens
  misc_feature: GYAE6OF01BUQT4.28.57.F02.1.454.CMB.1.raw
  modified_base (242)..(242): a, c, t, g, unknown or other
  misc_feature (242)..(242): n is a, c, g, or t
  modified_base (315)..(315): a, c, t, g, unknown or other
  misc_feature (315)..(315): n is a, c, g, or t
  modified_base (573)..(573): a, c, t, g, unknown or other
  misc_feature (573)..(573): n is a, c, g, or t
  modified_base (618)..(618): a, c, t, g, unknown or other
  misc_feature (618)..(618): n is a, c, g, or t
  modified_base (666)..(666): a, c, t, g, unknown or other
  misc_feature (666)..(666): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacgggagtttgggctgagtcgttgggttttccttgttgtcttaagttttaaaggtgtcctaggtgtggaggtgcagcgtggtgggagtcggtggggggcggtcgttcgggtccncggtccggttcgggggggtccctggacgtaccttccgtcctgtcgcgcgccgtcgtggtacttcctaccgttntagttatttagtcgtacttagtcgtaccgtcggttccgggcccgccgtacggtccctaccgggaaggggtaacggtacgtaggtaatgtagtcctagtaggttaattaaggaagttaagtaggaactaaataaactatattaattatacgactaaatcgtagtaggaggtacatacgtctaaccttgcctaacgaagaactaataaccaaagactcgtactagtatactacgaagtgaccaggctaacggattaccgngtagacggactacggcttacgtaagttagttcgagggtggggaancgggtagtacgggttaaggtagggtacgggttagggtgggtaccgggnggtaaccggg

SEQ ID NO: 267268 - DNA, 681 bp, Homo sapiens
  misc_feature: GYAE6OF01DR3JL.28.57.F02.1.454.CMB.1.raw
  modified_base (173)..(173): a, c, t, g, unknown or other
  misc_feature (173)..(173): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtggtttcgtgtgctatttaagtgtcngtgtgagtgcagctggtggagtggnggggngtcgttggaccngccggtcgggggtccctgacgctcctccgtgtcgcgcgtccgtcgtacggtcttccctaccttaccagttatttagcgtctatcgacgtcggtcggtcccgcgtacggccgaccggaagggtaacggtactagggtaaactaggttcgtccgttaaggtaagttagtaagtaaaggtatacgaacgtaaataaatattaactattactagtaactaacgtggtaagtaacggaaggtaccgtaacgtacgttacctacttccgttaccgtacgtaaacggtaacctaaccggtaaacaacgtaacccagtacctagttactacgttacgaagtcgacttacgacgtagactacggagtaggaaccggcggacgttcgttagttaaccgtattacgggtgggtaggagtaggtagggtaacgcgggttaaaggtacgtaagggttacggggtgggtaccgggaacgg

SEQ ID NO: 267269 - DNA, 760 bp, Homo sapiens
  misc_feature: GYAE6OF01DWMV9.28.57.F02.1.454.CMB.1.raw
  modified_base (324)..(324): a, c, t, g, unknown or other
  misc_feature (324)..(324): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtgggggagtcttggtccaggccgtcggggggtccctggagtactctccgtgtgcagtcctcgtggtacttctaccttactagttactttagtgcttatcgcgtacgtcgggtccncgacggtctaccggaaggggaaggacgtaggaatagtgtactacgtaaggtaattaagaagtaagtcggtaagtaaaattaaactaattaagtttaattaacgtagtaaccctaaaacgtttcgtaggtaaggaaacgggtacgtaacgttaacttaacccgacctaacgtccgtaacccggaacggtaacctaaacgtttaaccaaaacgtaaccgaccgttacgttaacgttacgttaacttaaccgtaacgtgggtacaacgtccgtaggaacgtacggtaccgtagtacggacgtacgggttaacttaggttaacttacgttacggttagggtaaggggtaagggtaacgggtaacgggtaacgggttaaaggttacgggttaaaacgggttggggggtttaacgggccgggggttacggtaaacccggggg

SEQ ID NO: 267270 - DNA, 707 bp, Homo sapiens
  misc_feature: GYAE6OF01ARI0A.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagcgtggtggagtcgtgggggaggcttggtccaggccgtgggggtccctgagactctcctgtgcagtcctcgtggtattccaccttctagttattatgtctatgctacgtcgggtcccgccgcggtcctaccggaggggaacgggtactacggaatagtcgtctacggtaaggttattaagaagttaagtagaacgtaaataaactattaactaatttatacgtaacctaaacgttcgtagtaacgggaagggtacgtaagtacttacccgaacctaacgttcctacccggtaacgggtaacctaaaccttaacccgaaagaaccgtaacgtacgttacgttacttaccgttaacgtaaggtaccgggtacaggtcccgaaggaacgtcgaccgtaagggcgaaccgtacggtactagttaacgtacgttacggtgggtagggaagtacggggtagtaacgggttaggtaaacgggtacggttagggggttcgggaaggggtcccggtaacggggg

SEQ ID NO: 267271 - DNA, 825 bp, Homo sapiens
  misc_feature: GYAE6OF01EAA2M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgacgactctcctgtcgcaggcctgtggacttccacctttctagttatttatgtctagtgcctacgtcgggtcccgccgacggccgtaccggaggggaacggtacgtaggtaataagtgttacgtcgtaagggttaattaacggtaaagtaagtacggaacgtaaagttaaactagttaaattaatttaacgttacgaacctaaacgttcgttaggtaggtaaacgggtacgtaaggtaacttaccgaaccctacgttacccgtaccggaaggtaacctaaacgtttaacccgaaacgtaaacgtaccgtacgtacgttttaaacttacctttaacgtaaagttcgggaaccgtaaccggttaccggtaggaacgggtaacggaaccggttaggaaccgggtaaccgtaccggggttacgttaaacggtttaacgttaaacggttttaacgggtacggggttaagggggaacgggtaaagggggtaaacggttaccgggggttaaaaacgggtttacggggttaaaaccgggtttaggggggttttacggggggtaacggggggtaacccgggtaaacgggggggg

SEQ ID NO: 267272 - DNA, 844 bp, Homo sapiens
  misc_feature: GYAE6OF01CSU1M.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcgttgggttttccttgttgtcttaagtttttaaaggtgtccagtgtgaggtgcagctgggtggagtcgtgggggaggcgtttcggtccacggtcccggttcggggggggtcccctggacggtacccttccgttcccgtggtcgcgacggtcccttcgtggtacttcccgtacctttcgtaagtttacttttatcggtaccttaatcggaccgtaccggtccggggtccccgaccggacggtacccgtacccggaagggggaacgggtaccgtaagggtaattagtcggttacgtacggtaaggttaaagtttaaggtaaagttaaacgtcggtaaactaaaagttaaacctaatttaaagtttaatttaacgtaacgtaaaccgtaaaccgtttcgtaaggttaacgggaaagggtacctaagttaaccttacccgtaaccctaacgttacccgtacggaaaccggtaactaaaccgttaacccgaaagtaacccgacgtaccttacgttacttaccgttaacgtaacggtaccgggactacggtaccgtaggacgacgttacggacggtaacggacgtaaccggtagttacgtaacgttacgtttaggtagggtagggaacgggtaaggacgggtaaggttaaagggttacgggtaacggttagggggtttaccgggacggggtaccggtaaccgggg

SEQ ID NO: 267273 - DNA, 739 bp, Homo sapiens
  misc_feature: GYAE6OF01C70RZ.28.57.F02.1.454.CMB.1.raw
  modified_base (175)..(175): a, c, t, g, unknown or other
  misc_feature (175)..(175): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtcgtgggggagcttggtccagccgtggggggtccctggagactctccgtgtgcagcctctggtattccaccttcagttatttatgctatgccacgtcggggtcccgccgaggcctaccgaggggaacgggtactgggaaatagtggtctacgaggttaattaagaaagttaatcgaacgtaaataaacaattattaacttaatgactaaaacgtctaggtaagaaagggtccaagtactttaccgaacctaactacctaccgaagggaacctaaacttaacccgaaagtaaccaaccgtacgttagtaacttaccgttaaccgaaagttccggggaactaacgtacccggttaggaacgggtacgtaccgtaggtaaccgggaccggtaaccggtaccgttaaggttaacttaaacgttaccggttaacggggtagggggaacggtaagggggaacggttaacggggtaaaggttttaacggggtaaacgggtttaggggtttaccggggtaggggggacccggttaaacggggggg

SEQ ID NO: 267274 - DNA, 852 bp, Homo sapiens
  misc_feature: GYAE6OF01DAY93.28.57.F02.1.454.CMB.1.raw
  modified_base (603)..(603): a, c, t, g, unknown or other
  misc_feature (603)..(603): n is a, c, g, or t
  modified_base (610)..(610): a, c, t, g, unknown or other
  misc_feature (610)..(610): n is a, c, g, or t
  modified_base (649)..(649): a, c, t, g, unknown or other
  misc_feature (649)..(649): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagtcgttgggttttccttggttgtcttaatttttaaaggtgtccagtgtgaggtgcagcgtggtggaggtcggtgggggagtcgttcggtccgaggtccggtcggggggtccctggaacggtcctcctccgtggtcgcgacgtccttcgtaggtacttcctaccttcgtagttatttagtcgtactagtcgaccgtacgtccggggtcccgccggacggtccgtacccggaagggggtaaacggtaccgttaaggtaaattagttcgtaccgttagttaaagggttaaagttaaggaaaacgtttaacgtacggaaaccgttaaaactaaacgttaattaatttaatttaacgtacgaaaccgttaaacgtcgttaggtaaggaaggtacgtaacgttccttaaccgacccttagtacccgaacggtaaacggtaacctaaacgttaccaaacggtaacnccggttntttaacgtaacgttccttaaaggaaacggttcggaaacnccggtaccggtaggtaaacgggtaccgttacggtaaacgggaaccggtaccgtaaccggtttagttaacgttaaacgttaccgtttagggtagggggggaaaggtacggggtaagttaacccggggtaaggttaaacgggttaccgggggtaaaaggggtttgggggttccgggggaacccggggaacgggttaacccggggg

SEQ ID NO: 267275 - DNA, 753 bp, Homo sapiens
  misc_feature: GYAE6OF01DKEJ8.28.57.F02.1.454.CMB.1.raw
  modified_base (318)..(318): a, c, t, g, unknown or other
  misc_feature (318)..(318): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccgtgggggtccctggagctctccgtgtgcacgcttcgtggtattcctaaccttcagttattttatcgtcttatgctacgttcgggggtcccnccgaggtcctacccggaagggggaacgggtaccgtagggtaattagttcgtcgtacgtaaggttaatttaaggaagttaatacggaacgtaaaactaaactaagttaatttaagtttaacgtacgtaactaaacgttcggttaggtagggtaaacgggtacgtaaggtactttaacccaacccgttagttaccctaaccgggtaaggtaaacctaaacgttaacccgaaagaacccgtacgttacgttacgtttaacgtacctttaaacgaaggttccgggcaacggtccgtagacgtaggaccgttaggaacggacgtacggtacttacgtaaagttacttacggtaggggtaggggaaagggaggtacggtaagggtaaggtttaccggggaaaggtttaaggggttcggggtagggaccggttaacgggggg

SEQ ID NO: 267276 - DNA, 595 bp, Homo sapiens
  misc_feature: GYAE6OF01DD3G0.28.57.F02.1.454.CMB.1.raw
  modified_base (175)..(175): a, c, t, g, unknown or other
  misc_feature (175)..(175): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtcgtgggggagcgttggtccagccgtggggggtccctggagtactctcctgtgcagcctcgtggacttccacctttcagttatttatgactatgcacgtcgggtccgccgaggcctccggaaggggaagggactaggaatntgtctacgaggtaattagaagtaangagaaataacattatatatnacaactgtgtagaaggcagtattacactatcncgaaggactaactacaanacagtactgtatcttanaagtgggacagtccgtagacggtgacgtaggacgacgacggtacttagtacttattacggtgggtaggggaaggagggaaggtacgggtaagttacgggtaaacgttgggggtttacgggcgggggtaccgtaacggggg

SEQ ID NO: 267277 - DNA, 772 bp, Homo sapiens
  misc_feature: GYAE6OF01A2E58.28.57.F02.1.454.CMB.1.raw
  modified_base (254)..(254): a, c, t, g, unknown or other
  misc_feature (254)..(254): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcngcctctggattcaccttcagttatttatgctatcgcacgtcgggtcccgccaggctccgagggaagggactaggaatatgtctcgtaggttattaagaagtaatgacgaaataacattatattatagactaaactcgtaggtaggaaggctaagttacttaccgaacctactaccgtaccggaacgggtaaacctaacttaacccgaaacggaaaccgtaccggtacttaaggttacttaccgtttaacgtaaacggttacggggaccgtaacggtcccgtaacgggaacgggtaccgggtaccggttaacgggaacggggaacccggtaacccggggttcgtttaaacggtttaaacgtttaacgtttaacggggttacggggttaggggggaacggggtaaacggggtaacgggttaaaccgggggttaaacgggtttaaacggggggttaaacgggttttaaggggggggtttacgggttaccgggggggggtaacccggttaaccggggggggg

SEQ ID NO: 267278 - DNA, 751 bp, Homo sapiens
  misc_feature: GYAE6OF01CZQGY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggttttccttgttgcttaagtttttaaaggtgtccagtgtgaggtgcagcgtgggtggagtcgtgggggaggtcttggtccaggccggtgggggggtccctggacgactctcctgtcgcacgcctcgtggtacttcctaccttcgtagttaattttagtcgtacttacgtcgcgtccgtcggggtaccccgccgacggaccgtaccgaaggggaacgggacgtaggaatagttcgtactagtaagttaagtaaggtaaagtaagtacgaacgtaaaataaactaataataattaagtactaacgtaaaactcgttaggtaaggaacgggataacggtacttacctactaacttccgtaaccgaagggtaaacctaaacgttaaccgaaagtaaaccccgagtacgtactaacgttaccgttaacgtaaaggccgggacacgtaccgtaggaaggacgaccgtaaggaacgggaccaggttacgtagttaaacgtaacgttaggttcgggagggtaaggacgggtaaacgggtaacggttaaggttaaccgggtaacgggttaaggggtaccggggtaccggggtaagggaacccggggg

SEQ ID NO: 267279 - DNA, 853 bp, Homo sapiens
  misc_feature: GYAE6OF01AV9R4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttagtttttaaaggtgtccagtgtgaggtgcagcgtgggtggagtcggtgggggaggtcgttcggtccacggccggttggggggtccctggacgtacctccgtccgtgtgccgacgtccctcgtaggtactttcctaccctttctagtttactttatcgtcttagtcgacgtaccggtccggggtcccgaccgacggtccgtaccgggaaggggtaacgggtacgtaggtaacttaggtcgttacgtacgtaaggttaagttaaggtaaagttaagtacggtaacgtaaaataaacgtaatttaagttaacttagtacgtaacctaaacttcgttaggtaacggaagggtactaagtaccttaccgaacgtacttaccgtacccggaaacggttaacctaaacgttaacccaaacgtaacccgtacggtacgtttagtttaaaccgttacccgttaacgtaaagggtaccgggtaaccgacggtaacccgggtaacgtaaacgggacggtttacggtaacgggaacccgggtaacgtaaccgggttagttacggtttaaactttaccgggtttacggagggggttaacggggaaagggtacgggtaaccgggttaagggttaaacggtttaacgggggtaaacgggtttacgggggtaggggtacccggggacggggttaacccggggg

SEQ ID NO: 267280 - DNA, 857 bp, Homo sapiens
  misc_feature: GYAE6OF01DZEM2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaagtttttaaaggtgtccagtgtgaggtgcagcgtgggtggagtcgtgggggaggtcgttcgggtcccgaggcccggttcgggggggtcccctaggacgtaccttccgtccgttggtcgaccacgtcccttcgtggtacttcctaccctttctaagtttatttagtgtcttatcgacctacggtcggggtcccgaccgtaacgggtcccgtacccggaagggggaaacggggtctagggtaaattagttcgtacttacggttaaaggttaaagttaaagggtaaaagttaacgttaggaaacgtaaaaactaaacgtaattaagtttaattaacgtaagaacttaaaacgtcgttaggtaggaaacgggtacaagttacttaccaacctacgtaccgtacccgaaaggtaacctaaacgttacccgaaaacgaacccgtacgtaccgttaacggtttactttacccgtaaagtaaacggtcgggtaactccgggtaccgtagggaaacggtacggtaccgtaagggaaacccggtaaccgtaaccgggtccgtttaaggtttaaattacgggtttaacggtagggggtaggggtaaacggaaggggtaacgggtaacgggttaaagggtttaacggggtaacgggtttaaagggggggttcggtaacgggggtacccgggtaaccgggggg

SEQ ID NO: 267281 - DNA, 700 bp, Homo sapiens
  misc_feature: GYAE6OF01EQZXB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctctggacttcaccttcagttatttatgctatgcacgtcgggtcccgcgacggcctaccggaggggaacggacgtaggaatattgtctacgtaggttaagttaagaagtaatagacgtaaataaactaattaattaattagtacgaacctaaacgtcgtaggtaggaacgggtacaagtactttaccaacctattacccgtaccggaaagggtaaacctaaccgttaaccgaaaacggtaacctaaccggtacttacgttaaccttaccgttaacgaaaggttcgggactacggccgtaggagtacgtgtacggaacgggaccgtacggcttacgggttaattacgttacggtggggtaggggaagtacggggaacgggtacggttaaaggttaacggggtaacggttagggggtttcggggcggggtacggtaaccggggg

SEQ ID NO: 267282 - DNA, 784 bp, Homo sapiens
  misc_feature: GYAE6OF01DM9AX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgcttatttttaaaggtgtccagttgtgaggtgcagctggtggagtcgtgggggagcttggtccagccgtgggggtccctgagctctcctgtgcagtcctagtggtacttcctacccttagtaagttatttagtcgtacttagtcgcgtaacgtccgggttacccgcgtacggtaccgttacccgggaaggggaacgggtacgtagggtaaattagttcgtaccgttaagaaggttaagttaagtaaacgttaagtacgaacgtaaaataaactaattaatttaaattaagtacgaaacctaaaccgtgtaggtaaggaaacgggctaagtacgttaccaaccgtatacccgtacggtaaacgggtaactaacgttaaccgaaacgaaacgtaccgttactaacgttaacttaccttaaagtaaaccggtcggacgaacgtccggtaggtacgagttccggtaagaccgggtaacgtacggtacgtaagtttaacgttaaacgttacggtaggggtaacgggaagggtaacggggaaacggtaacgggttaaaaggtttaccgggggtaaaacggttttcgggggtacgggggttaaccggggaccgggttaaaccccggggg

SEQ ID NO: 267283 - DNA, 677 bp, Homo sapiens
  misc_feature: GYAE6OF01CDKOV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggtaggtttggccagccggtggggggtccctgagtactctcctgtgcagcctcgtggattcctaccttctagttatttatgtctatcgactacgtcgggtccgccgacggtcctaccggaggggaaggtacgtggaattagtcgtacgtacgtaaggttagttaagaaagtaatgaacgaaataaacgtaataattattactagaactaaacgtcgtaggtaggaaaggcaagtactacaactactcctacgaaggtaactaataaccgaaacgaacctacgcttagtacttactaacgaacgtggacacgaccgtaggaacgacggtaccgtaggacgtaacgacggtacgtagttagtacgttaggtagggttacggggaggaacggtaagggtacgggttaaaggtaggggttaaacggttagggggttacggggacggggtaccggtacggggtacccggg

SEQ ID NO: 267284 - DNA, 570 bp, Homo sapiens
  misc_feature: GYAE6OF01E4R0X.28.57.F02.1.454.CMB.1.raw
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtgggggggtccctgagactctcctgtgcagcctctggattcaccttcagtatttatgctatgcacgtggtcccgcaggctccgagggaggactggaatatgtctcaggtattagaagtaatgacgaataacatatattatagacaaactctagtgaagggcagtatccaccatctaccgaggaacaacttaccaaagaacacgactagtactacttacaagtggacagccgtagacgagctagacggacgacggtcgtgtaatacttacgtgggtagggaaggngggacggtagggaagttagggtaacggttaggggttcgggtggggccggtaacggggg

SEQ ID NO: 267285 - DNA, 818 bp, Homo sapiens
  misc_feature: GYAE6OF01CDAXD.28.57.F02.1.454.CMB.1.raw
  modified_base (253)..(253): a, c, t, g, unknown or other
  misc_feature (253)..(253): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtcagtgtgaggtgcagctggtggagtcgtgggggagcgttggtccagccgtggggggtccctgagactctcctgtncgagcctctggacttcaccttcagttatttatcgactatcgctacgtcgggtcccgccgaggtccgtccgaagggggaaacggggtaccgtaggggtaaacttagttcggttacccgtacggtaaagggttaatttaaaaggtaaagttaaacgtggaaaccggtaaataaaacgttaattaactttaagtttaactagtaaaccctaaacttccgttaggtaagggaaacggggtcctaaggtacttaacccgaaccctacttaccgtaacccggtaaagggtaacctaaacgttaacccaaaacggtaaaccgaaccgtaccgttaacgttacttaacccgttacgtaaacggtgggacctaaccggtaccgtagggaacggtacgtacgtacgggaaccggaccgtaacgggtacgttacggttaacgttaacgtttacggttaggggttaggggaagggtaacggggtaacggggtaaaccgggttaaagggtttaacgggggtaaacgggttttaagggggggtttacggggtacggggggtacccggtaaacggggggg

SEQ ID NO: 267286 - DNA, 920 bp, Homo sapiens
  misc_feature: GYAE6OF01D0KGT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctcgtggattccaccttcagttatttatgtctatgctacgtcgggtcccgccgaggtcctccggaaggggaaacgggacgtagggtaaattagtgtctacgtaggttaattaaggaaagttaacgtggaacgtaaaataaacgtaattaattaaagtttaactacggtaaactaaaaccgttcgttagggtaaacggaaacggggtacctaaggttactttacccgaaacccgttaaccttaccccggttaacccggaaaacggggtaaacccttaaaacgtttaaccccgaaaacgggtaaaccctaaccgggttacccgttaacgtttaaacgtttacccttttaaacggaaaaacggtttacgggggtacccgtaacggtaccccgttagggaaacccgggttaaggtaacccggttaaggggaaacccgggtaacccggtaaacccggggttacgttttaacgggtttaaaacggttttaaaccggttttaacgggtacgggggtttaacggggggaaaacggggttaacggggaaaacgggggttaacccggggttaaaaggggttttaacgggggtaaaaacccgggggttttttaggggggggtttaaccgggggttacccggggggtaaccccgggggtaaaaccggggggggg

SEQ ID NO: 267287 - DNA, 859 bp, Homo sapiens
  misc_feature: GYAE6OF01DHNTH.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaatagtcatggacggtagttgggctgagtcgttgggttttccttgttgtcttaattttaaaggtgtccagtgtgaggtgcagcgtgggtggtaggtcggtggggggtacgtcgtttcgggtacctacggtccgggttcgggggggtccctaggacgtaccttccttccgtggtcggctacggtccttcgtacgggtactttacctacccgtttagtaaggtttaagttttaactcggtacctttagtaccggtactaccgggttccggggtcccgaccggtacgggtccggttaaccggaaagggggtaaccggtacgtaggtaactagttcgtacgtacgtaaggtagttaagtaaacgtagtacgtaacgtaaaataactaacgttaattaacgtttacgaacgtaaccttaaacgtcgtaagggtaggaacggtacgtaacgtaccttaccgaactaccgttacgtaaccgtaacggtaaactaaccgttaaacgaacggaacctaccggtacttacgttactaacgttacaaacggtcgggtacctacgggtacgtaacggtacggtacggtaccgtacggtaacgggtaaccggtacggtacgtttaaggtaaaccgtttaagaacgggtttcggggaagggttaacgggtaacggggaacgggttaaacggttaacggtacggggttaacggggtaagggtttaccggggacggggttaaccgggtaaacggggg

SEQ ID NO: 267288 - DNA, 805 bp, Homo sapiens
  misc_feature: GYAE6OF01C7BA8.28.57.F02.1.454.CMB.1.raw
  modified_base (182)..(182): a, c, t, g, unknown or other
  misc_feature (182)..(182): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttggggctgagtcgttgggttttccttgttgcttaatttttaaaggngtccagtgtgaggtgcagcgtgggtggagtcggtgggggagtcgttggtccaggccggtcggggggtccctagacgtacctctccgtgtgcgacgccttcgtggacttcctaccttnaagtttatttagngtactagtcgacgtacggtcgggtcccgaccgtacggtccgtaccggaacgggggtaaacggtaccggtaagggtaattacgtacggttaccgtaccgggtaaggttaaagttaaagggtaaacgttaagtaacggtaaacgtaaaattaaacctaatttaagtaaacttttagtacggtaaccttaaacgttcggtttaaggaacgggtaaacgggtaacttaacggttaaccgttacccaaaccgtaaccgttacccgtaaaccgggtaaaccgggtaaaccttaaaaccgttaaccgaaaacgtaacccgaacggttcgtttaaacgtacgtttaacgtaaccgaaggttaccgggacaagtccgtaagtacggacgtcgaggtaacgggactaacggtcgttactaaagttggtaccgttagggacggttaaggaccggtaaggtacggttaggtaggtaacggttggggtaggccgggtagaccgggg

SEQ ID NO: 267289 - DNA, 752 bp, Homo sapiens
  misc_feature: GYAE6OF01BEDAQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtgggggtccctgagactctcctgtgcagcctcgtggacttccaccttctagttatttatgtactatgctacgtcggggtcccgcacgggccgtaccgaaggggaacgggtacgtagggaatagtcgtcgtacgaaggttaagtttaaggaaagtaacgtggaacgtaaattaaacgtaatttaattaatttaagtacgtaactaaaaccttcgttaggtaagggaaacggggtactaaggtactttaaccgaaccctattacccgtaccgaaggggtaacctaaacgttaaccaaacgtaaccgacgtacgtttgttaacctaccgtttaacgaaaggttacgggacctaacggtccgtaggaacggtagtacgtaggaacggacgtaccgggtcgtagttaaacttaacgtttacggtagggttaggggaagggaaacggggtacgggtaagggttaaacggtttacgggaaaccggggtttagggggtttaccgggtcggggggtacccggtaaaccgggggg

SEQ ID NO: 267290 - DNA, 785 bp, Homo sapiens
  misc_feature: GYAE6OF01EI1VN.28.57.F02.1.454.CMB.1.raw
  modified_base (233)..(233): a, c, t, g, unknown or other
  misc_feature (233)..(233): n is a, c, g, or t
  modified_base (719)..(719): a, c, t, g, unknown or other
  misc_feature (719)..(719): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtaggtttgggctggagtcgttggggtttttccttggttgtacttaattttttaaagggtcgttccagtggtgaggtgcagcgtggtggagtcggtggggggngtcgttggtccgaggtccggttggggggtccctggacggtccttcgtccgtgtgcgtacgccttcgtggtacttccacctttacgtagttatttttagtgtaccttagtcgtaccgtacggttccggggtcccgccggtaaccgggtcctaccgggaagggggaacggggtaccgttaaggaacttagttagttaccttacggtaaggtttaattaaggtaaaggttaactagtaaaccgtaaattaaactaattaatttagttaatagtaaactaaacgtcgtaggtaaggaacgggtactgtactacctaccgtactccgtacggaaaggtaaccgttaactaaccgaaaacgtaacgtaccgtacgtacttacgtttaactaaggaacgttcgggacttaacgccgttaagacggtcgtagttaacgggaccgtaccggacgttagtactttaagttacggtacggtttgggagggttaaggnggagggtaaacgggttaagttacgggaacggtttaggggtcggggaaccggggtcggtaaccgggg

SEQ ID NO: 267291 - DNA, 957 bp, Homo sapiens
  misc_feature: GYAE6OF01BK0CI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagttcggtgggggaggtcgtttcgggtccaggtcccggttcgggggggtccccttggacggtaccttccgttcccgttggtcgaccgtacggtccccttacgtgggtactttcccgaacccttttcgtaaggtttatttttaagtcggttacttaacgttcgtaccgtacggttccgggggtccccgaccgaacgggtcccgtaacccgggaaggggggaaacgggtaaccgttagggtaaactttacgttccggttacgttaaccggtaaggtttaaagtttaaaggaaaaggtttaaacgtaacggttaaacccgtaaaaaattaaaccttaaagttaaaattttaaacgtttaaagttacgaaacccttaaaaaccgtttgtttaacggtaacggggtaaaccgggtacttaaaacgttaaccgtttaccccaaaccgttaccgttaccccgtaaaccgggtaaagggttaacctaaaaccgttaacccgaaaaacggttaaaccgaccgttaacgtttacgttaaactttaccgttaaaccggaaaggttccgggacctaacggtccgtaaggacggtaagtaccggtacgggaaccggaaccgtccgggtaagttactttaaacgttaacgttacggttacggggaagggggtaacggtaaggggtacggttaaacgggttaaacgggtttacggggtaaacgggtttacgggggttcgggaacccgggggggtccggtaaaccggggg

SEQ ID NO: 267292 - DNA, 804 bp, Homo sapiens
  misc_feature: GYAE6OF01CBPDE.28.57.F02.1.454.CMB.1.raw
tcagagtacgctatcacgaccggtgctcgatttagctcgatatagttgggtctgggagaggagccccccgccctgggtttccccaggtgttctcatttggtgatcagcactgcacacgagaagagtcagtgacggtagtttgggctgagtcgttgggttttccttgttgtcgttaagtttttaaaggtcgttccagttggtggaggtgctagtcgtgggtgggtacggtcggtggggggaggtccgttcgggtacccgacggtcccgggttcggggggtccctagggacgtaccgttccgttccgtgtcgcgacgtccttcgtgtacttcctaccttctaagttattttactcgtacttagtcgtaccgaccggttccgggtcccgacccggacggtacccggtaaccgggaagggggtaaccgggtaacggttaagggttaaattacggttacgtacgttaccggtaaaggtttaagttaaaggtacgtaaagtacgaaacgtaaattaacgtaattaatattagaactacgtaaacgtcgtaggtacggaaggtcaagttactacaccgactaccgacgtaggaacctaacgtaacgaacgaaccgacgtatacgtacgttaccgtaacgaaggtcggactaggtaccggaggagacggtccgaaggtaaccggacggtacgtcggttaagttaccgtaagttcggtacgggtagggtaaccggtaagggtaccgggtaaaggttaacgggttaacgggtaaacgggtttaggggcggggttaccggggacgtacccggggg

SEQ ID NO: 267293 - DNA, 765 bp, Homo sapiens
  misc_feature: GYAE6OF01DF7F6.28.57.F02.1.454.CMB.1.raw
  modified_base (432)..(432): a, c, t, g, unknown or other
  misc_feature (432)..(432): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttatttttaaaggtgtccagtgtgaggtgcagctgggtggagtcgtgggggagcttggtccaggccgtggggggtccctgagacctctccgtgtcgacagtccttcgtggtacttctaaccgtttcaagtttatttatgtacttagtcgactacgtcgggtcccgccgaggtccgtacggaaggggaacggacgtaggaactagtcgttacgtagtaaggtaattaagtaagtaaagtcgaagtaaaataactaattaattaacttanacgtaactaacttgtaggtagtaaggactagtaacttaccaaccgtaactccgtaaccggtaaggtaactaaaaccgttaaccgaaacggtaacctacggttaccttaacggttacttaaccgtttaaacgaaacggttcgggaacctaacgggtacccgttaggaaacgggtacggtaccggttaaggaaccgggtaaccggtaccggttacgttaaacggtattttaacggtacggttaggggtacgggtaagggtaaccggtaaggtaacgggtaagtttaaggggtaaacgggttgggggttacgggacgggggtacccggtaacgggg

SEQ ID NO: 267294 - DNA, 544 bp, Homo sapiens
  misc_feature: GYAE6OF01AEM39.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactcgtgtgaagggcagattcacctatctaccgagggactaacttaccaaagaacacgctagtactctacaagtgggcagcctgagagactgagacgacggctgtatattacgtggtagggagagggagaggtaagttacggaacggttagggttggtggggcgtaacggggg

SEQ ID NO: 267295 - DNA, 662 bp, Homo sapiens
  misc_feature: GYAE6OF01CXTUY.28.57.F02.1.454.CMB.1.raw
  modified_base (309)..(309): a, c, t, g, unknown or other
  misc_feature (309)..(309): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggagcttggtccagccgtggggggtccctgacgactctcctgtgcagcctctggattccacctttcagttatttatgctagtgctacgtcgggtcccnccgagcctccggaaggggaaggacgtaggaatagtgtctcgaggttataagagtaatgacgaaataacaattatatttanagaactaaactcgtagtagaggcagtacttacactatctacgaggaactaactaccgaagaacacgtacttagtactaccgtttagaaagtcgggtacaacgtcctaggagacgtacggacggtacggacgtaccgtagttagtaacgttaacgttacgtagggttaggggaaggtaacggggtacgggtaaaccggttaaaggttaacgggggttaaaccggtttaaggggggtttccggggaaagggggtacccgggttaaacccgggggg

SEQ ID NO: 267296 - DNA, 822 bp, Homo sapiens
  misc_feature: GYAE6OF01AWQKV.28.57.F02.1.454.CMB.1.raw
  modified_base (333)..(333): a, c, t, g, unknown or other
  misc_feature (333)..(333): n is a, c, g, or t
  modified_base (357)..(357): a, c, t, g, unknown or other
  misc_feature (357)..(357): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatggacggtaggtttgggctgagtcgttgggttttccttgttgtactttaagtttttaaaggtgtacctagtggtggaggtgcagtcgtgggtggagtcggtggggggagtcgttcggtaccgacggtcccggttcggggggtccctggacgtacctcctccgtgtcgcacgtcctcgtggtacttccacctttcgtaagttatttangtactatgaccacgttcgggcccncgacgcctaccggagggaggactaggaatatcgtctagtaaggttaagttaagaaaggtaatcgaacgtaaaacgtaaactaagttataagtttatacgtaactaaacttcgtaggtaacggagggactaagtacttaccaacctagtaccgtaccgaacggtaacctaacgttaaccgaaaacggtaaccctacggttaacttagttaaccttaccgttaaaacgtaacggtccgggtaactaaccggtacccgtaagggtaacccggtaaggtccggtaaagggaaccgggtaacccgtaaccgggttaactttaacggttaaatttaaccgggtttagggtacgggttaaggggggaaggttaaagggggtacggtaaaaccggggttaaagggtttacccgggggttaaagggtttaagggggttacgggggtacggggggtacccgggtaaacccggggg

SEQ ID NO: 267297 - DNA, 862 bp, Homo sapiens
  misc_feature: GYAE6OF01DCFEC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgcttaatttttaaaggtgtccagtgtgaggtgcagctgggtggagtcggtgggggaggcgttggtccaggcccgtcgggggggtccctggagtacctctccgtgtcgcagtcctcgtaggtacttccacctttcaagttatttatcgtacttatcgctaccgtcgggtcccgaccgacggtccgtaccggaagggggaacgggacgtcgggtaaatgtagttccgtacgtaggttaattaacggaagttaactggtaaccgtaaaacttaaaactaatttaatttaaatttaacgtacggtaacctaaaccgtttacgtaggtaacggtaaacgggactaagttaccgttacctaaccctaacgttacccgtaacccggaacgggtaaacctaaacgtttaaacccgaaaccggtaaacccgtaacggttacccttaaacggttaactttaacccgttttaaacggaaacggttcggggtaaccgtaaccggttaaccgttaacgggaacggtacggttaccgtaacgggaacgggtaccggtacggttaccgttaaggttaaccgtttaagttaaccggtaggggtaagggggtaacgggtaaagggtaacggggttaaccggttaaagggtttaaacggggttaaacgggtttagggggttacggggtacccggggggtaccgggtaaaccgggggg

SEQ ID NO: 267298 - DNA, 816 bp, Homo sapiens
  misc_feature: GYAE6OF01EXE97.28.57.F02.1.454.CMB.1.raw
  modified_base (716)..(716): a, c, t, g, unknown or other
  misc_feature (716)..(716): n is a, c, g, or t
  modified_base (741)..(741): a, c, t, g, unknown or other
  misc_feature (741)..(741): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtggggggaggtcgttgggtccaggtccggttgggggggtcccctggacgtaccgtcctcccgtggtggcctacgcccttcgtggtacttcctacctttcaagttattttatcgtactatggcctacggtcgggtcccgccgtacgggtccttacccgggaagggggaacgggtaccgtagggtaaacttagttcgggtaccttacggtaaggtttaagttaaaggtaaacgttaagtacggaacgtaaaactaaacttaagttaattaacgtttaatacggtaacctaaaaccgtccgtttaggtaagggaaaacggggtctaaggttaacccgttacctaacccgtaacgttcccgttaacccgggtaaagggtaaaccttaaaccgttaacccggaaaacgaacccgtaccggtacgtttaacgttaaccttcgttaaacgtaaacggtcgggtaaccacgtccggttaaggaggtacgtacgtacgggaacggtacgtaccgggtnttaaggtttaagtacgtttacgggnggtagggggaacgaggggacgtaagggtaacgttaagggtacgtttagggggtcgggtacggggcgggtacgggg

SEQ ID NO: 267299 - DNA, 720 bp, Homo sapiens
  misc_feature: GYAE6OF01ETAOC.28.57.F02.1.454.CMB.1.raw
tcagagtacgctatcacgaccggtgctcgatttagctcgatatagttgggggtctggggagaggagcccccgccctgggtttcccagggtgttctcatttggtgatcagcactgcacacagaagagtcatgacggagtttgggctgagctgggttttccttgttgcgtatttttaaaggtgtccagtgtgaggtgcagctcggtggagtcgtgggggaggcgttgggtccaggccgtggggggtccctgagtactctcctgtgcagcctactggacttcacctttcaagttattttaatgctatggacactcggggtaccgaccacgggaccttacccgaaggggaacgggacctagggaatagtagtctacgaaggttaagtttaacgaaacgtaagtacgacgtaaataactaataatagttaactacgataaaacctcgtaggtacggaaacgggctaacggtacttacctaacccaacttcttaacccgaagggggaacctaacgttaccgaaaactaaacggtaccgaccgttagtaacttctttaaccgaaaggttggtaccgagaaccctggaacgtacgcgttagaacggaccggtacggactacgttaaattacgttaacggtcgggttagggtaagggacgggtaagggacgggttaaacgtacggggtaaagttaagggggtcgggttaggggacccggtaacgggggg

SEQ ID NO: 267300 - DNA, 786 bp, Homo sapiens
  misc_feature: GYAE6OF01BO7NN.28.57.F02.1.454.CMB.1.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgtcttaagttttaaaggtgtccagtgtgaggtgcagctggtggagtcggtgggggaggtcgttggtccgaggtccggtggggggtccctgagtacctctccgtgtcgccgacgtcctcgtgtcttacctaccttnaagttattntcgtactatcgcgtacggtcgggtcccacgtacggccgtaccgggaaggggaacggtacgtaggtaactagtcgtacctagtaaggttactaaggtaattaagagtaaccgtaaaatataagttaattacttaatacgtaactaactgttaggaggaaaggtactagtactaccgtactaccgtaccgtaccggtaacggaaactaacgttaaccccgaaaggtaaccctaccggttacgttaccgttaacttaccgttaaacgtaaacgggtcggaactaccggaccgttacgtaacgggtacgtcggttaacggaaccgggtacgtaaccggttacgttaaggtttaacgttaaacggttacggtcgggggtaaagggtacggtaaaacgggttcggaaacggggtttaaacggttaaacggggtaaccggggtttagggggttaccgggtccggggggtaaccgggtaaccggggg

SEQ ID NO: 267301 - DNA, 592 bp, Homo sapiens
  misc_feature: GYAE6OF01D8H1W.28.57.F02.1.454.CMB.1.raw
  modified_base (288)..(288): a, c, t, g, unknown or other
  misc_feature (288)..(288): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (499)..(499): a, c, t, g, unknown or other
  misc_feature (499)..(499): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccaggccgtgggggggtccctgacgactctcctgtgcagcctctggattcaccttcagttactttangctatgcacgtgggtcccgcgacggctccggaggggaacggctagggaatatcgtctacgaggtattaaggaagtaatgacgtaaataacatagtaattangacaaactcgtaggtagaagggacagtatccactatcncaggactatccaagacacgntgatctanaagtgggactagcctaggagacgctagggaacgaccgacgggtntaggttattaacgtacgtgggtagggaggtacgggagtacggttaagtagggtaaacggttgggggttaacggtcggggaacccgtaaggggg

SEQ ID NO: 267302 - DNA, 806 bp, Homo sapiens
  misc_feature: GYAE6OF01CJH57.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatggacggtagtttgggctgagtcgttgggttttcctgttgcgttaattttaaggtgtcagtgtggaggtgcagtcgtgggtggtagtcggtgggggagtcgttggtcccgaggtccggttcggggggtccctaggaacggtaccttccgtccgtaggtcgccgtacgtccgttcgtacggtactttacccgtaacctttcgtaagtttatttagtcggtacttagtcggaccgtacggttcgggtcccgaccgtacggtccgtaccgggtaaggggtaacggtaaccgtaggtaaattcgtacgttactaacggtaaggttaagtaaaggtaagttagacgaagtaaataacgtaattaagtaattagactaacgtaacgtcgtaggtaacggaacgtacgtaagtactaccaacttacctaccggtaacgtaaacgtaaacgtaaccttaaccggaaacgtaacgtacgttaaccgttagtaccttacgtaaacgtaaggccggtaacaccgtacggtaaggtaacgtacggtacggttaacggacggtaccggaacgttagtacgttaaacgtcggttaacgggtggtaacgggggaagtaggggtaacggtaaacgggtaaggttacggggtaacgggttagggggttaccggtacgggggtaccggtaacccgggg

SEQ ID NO: 267303 - DNA, 817 bp, Homo sapiens
  misc_feature: GYAE6OF01DCFL4.28.57.F02.1.454.CMB.1.raw
  modified_base (180)..(180): a, c, t, g, unknown or other
  misc_feature (180)..(180): n is a, c, g, or t
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcgttgggttttccttgttgcttaatttttaaaggngtccagtgtgaggtgcagtcgtggtggagtcgtgggggagcttggtccagccgtcgggggtccctggagcctctccgtgtcgcagtcctcgngtacttccaccttnagtttatttatgtactagtcgcgtacgtcgggtcccacgacggtccgtaccggaaggggtaacggtactaggtaacttacgtacggtcctaacggtaaggttaacgtttaaaggaaagttaagttacggaaaccgtaaaattaaaccgtaaagttaattaaagtttaacgtaacggtaaccttaaacggttcgtaagggttaagggtaaacgggacctaggttaaacttttaccccgaaaccgttaacttcccggtaaaccggtaaagggtaaacctaaaccggtttaaacccgaaacgtaaacccgtagttacccgttaacgtaacgtttaccctaaagtaacggttacggacgtaacgcgttaaccgggaagtacgtacggttacggaaccgacgtaacgggtactttaaggttaacgttaccttacggggtaagggaacgggtagggtaaaccgtaggggttaaacggttacggttaacggggtaacgggtttaggggttacgggaccggggtaacggtaaccggggg

SEQ ID NO: 267304 - DNA, 779 bp, Homo sapiens
  misc_feature: GYAE6OF01E2RNS.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggtttttccttgttgcttatttttaaaggtgtccagtgtgaggtgcagctggtggagtcgtgggggaggcttggtccagccgtggggggtccctgagactctcctgtgcacgcctctggacttccaccttcagttattttatgctatgctacgtcgggtcccgccacgggctaccgaaggggaagggaccgtagggtaattagttcgtcctacgtaaggttaattaaggaaagttaataggacgaaaataaactaattaattaatttatacgtaactaaaaccttcgtaggtacggaaacgggtactaagttacgttaccaacccgtacttaccgtacccgaaagggtaaacctaaactttaaccccgaaaacgaacccgtaaccggtacctttaacggttaaacctttacccgttaacgtaaaacgtcgggtaccgtaaccgtcccggttaaggaacgggtacgtaccgttaagggaaccggtacccgtaacgggtacttacggtttaaacttaacggtttacggttaggggtagggggaaggtaacgggggacggtaacgggttaaaggtttacggggaaacgggtttaaggggtttcggggtacgggggtaacccggtaacgggggg

SEQ ID NO: 267305 - DNA, 717 bp, Homo sapiens
  misc_feature: GYAE6OF01AQOG6.28.57.F02.1.454.CMB.1.raw
  modified_base (252)..(252): a, c, t, g, unknown or other
  misc_feature (252)..(252): n is a, c, g, or t
tcagagtacgctatcacgaccggtgctcgatttagctcgatatagttgggtctgggggagaggagcccccgcccctgggtttcccaggtgttctcatttggtgatcagcactgcacacagaagagtcatgacggagtttggggctgagctgggttttccttgttgctatttttaaaggtgtccagtgtgaggtgcagctggtggagtcgtgggggaggcttggtccagccgtgggggggtccctgagactcncctgtgcagcctctggattcaccttcagttattatgctatgacacctgggtccgaccaggtctccgaggggaacggactggatatgtactcgtaggtattagaagtagtgacgtaaataacagtataagtttactagacctaaactcgttagtaggtaagggactagtacttaccaactactcctaccggagggaacctaacgttaccctaaagacctacggtctacgttactacctttacaaaggtcgggactaacggtaccgttaggaacgtaggtccgttagggtaaccgggacccgtaacgggtccggttaagtttaaccggttaagtttaaccgggtagggtttacgggggaaaggaccgggggtaacggtacccgggggttaaaggtttaacccgggggttaaaacggttccgggggggttttaagggtccggggggttaacccccgggaacggggggg

SEQ ID NO: 267306 - DNA, 864 bp, Homo sapiens
  misc_feature: GYAE6OF01D0LCF.28.57.F02.1.454.CMB.1.raw
  modified_base (197)..(197): a, c, t, g, unknown or other
  misc_feature (197)..(197): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggtttttccttgttgcttaagttttttaaaggtgtccagtgtgaggtncagtctggtggagtcgtgggggagtcgttggtccaggccggttcggggggtccctggacgtacctccgtcctgtgcacgtcctcgtagtattcctacctttcaagtttatttatgactagtcgactaccggtcgggtcccgaccgtacggtccgtaccgggaagggggaacggtacgttaggtaaattacgttcgttaccgttacggtaaggtttaaagttaaggtaaaagttaacgtacgtaaacggtaaaattaaaactaattaaatttaagttaactacggtaacctaaaacgtcgtaaggtaggtaaacgggacgtaagttaacttaccaaccttaacgttaccgtaaccggtaacgggtaaacctaaacgtaaacccgtaaacgtaaacccgtaccggttaccgttaacgttaacttaccgtttaaacgaaacggttcggggaactaaccgggtccgtaaggtaacggtacggtaccgtaacgggaaccggtacccggtacgggtaccgtttaagttaacgtttaacggtttaacgggttaaggggttaaggggaacgggtaaaggggtaacgggttaaacccgggttaaagggttaaccggggtttaaacggggtttaccgggggttagggggttaccgggggaccgggtaaacccggggg

SEQ ID NO: 267307 - DNA, 585 bp, Homo sapiens
  misc_feature: GYAE6OF01AW3L2.28.57.F02.1.454.CMB.1.raw
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctattttaaaggtgtccagtgtgaggtgcagctggtggagtctgggggaggcttggtccagcctgggggggtccctggagactctcctgtgcagcctctggattcaccttcagtatttatgctatgcacgtggtccgccaggctccgaggggaaggctaggaatatgtctcgaggtatagaagtaangacgaataacatatattangacaaatctagtacgaagggcagtatcaccatctcaggacaataccaagaacacgctagtactctacaagtcgggacagcctagagtacgacgtggacggacctacggcgtaggttatacggtttacgtacgggttaggggaggaacgggtacggagggtaaacggtttggggaaacggttaggggtttcggggtacggggggccgtaacggggggg

SEQ ID NO: 267308 - DNA, 646 bp, Homo sapiens
  misc_feature: GYAE6OF01C2U46.28.57.F02.1.454.CMB.1.raw
  modified_base (260)..(260): a, c, t, g, unknown or other
  misc_feature (260)..(260): n is a, c, g, or t
  modified_base (407)..(407): a, c, t, g, unknown or other
  misc_feature (407)..(407): n is a, c, g, or t
  modified_base (576)..(576): a, c, t, g, unknown or other
  misc_feature (576)..(576): n is a, c, g, or t
  modified_base (585)..(585): a, c, t, g, unknown or other
  misc_feature (585)..(585): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtcagtgtgaggtgcagctggtggagtcgtgggggagcttggtccagccgtggggggtccctgagactctcgtgtgcagcctcnggtattcaccttcgagttatttatgtctatgctacgtcgggtccgaccgaggcgtccgaaggggaacggacgtaggaattagtagtcctacgtagggttaattaaggtaagttaaacgtggaacgaaataaataattaattaattanagtaacaacgttcgtaggtaggaaggtacaggtattaccgactactccgtaccgaaggtacctaacttaaccgaagaacgtacgtctagttactacgtttaacaagttcgggctaacgtcgtagtagacgtgaggtaacgggacacggtacttagttagttagttacgnggtaggggngaagggtaaggtcggtaaggttacgggtaaggttaggggttcgggtcgggcggtaacgggg

SEQ ID NO: 267309 - DNA, 622 bp, Homo sapiens
  misc_feature: GYAE6OF01CQRYF.28.57.F02.1.454.CMB.1.raw
  modified_base (408)..(408): a, c, t, g, unknown or other
  misc_feature (408)..(408): n is a, c, g, or t
  modified_base (496)..(496): a, c, t, g, unknown or other
  misc_feature (496)..(496): n is a, c, g, or t
  modified_base (510)..(510): a, c, t, g, unknown or other
  misc_feature (510)..(510): n is a, c, g, or t
  modified_base (523)..(523): a, c, t, g, unknown or other
  misc_feature (523)..(523): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctggtgggagtcgtgggggagcttggtccaggccgtggggggtccctgagactctcctgtgcagcctcgtggacttcaccttcagttatttatgctatcgcacgtggggtcccgccgacggcctccgaaggggaaacgggaccgtgggaaacttgtcgttcctacgaggttaattaagaaagttaagtgaacgaaattaacaattaataattangtaactaaactctaggtaggaaggcaagtacgttccaacactccgtaccgaagggaactaacttaaccaacgaaccagtctagtactntacgaagtgggacngccaggcgagacnggacgacgaccgtgtacgtatattacggtagtgggaaggtaggacggtaagggtaagttagggtaaacggttaggggttcgggcggggtcgtaacgggg

SEQ ID NO: 267310 - DNA, 719 bp, Homo sapiens
  misc_feature: GYAE6OF01BUHSW.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatggacgggtaggtttgggctgagtcgttgggttttccttgttgtcttaatttttaaaggtgtccagtgtggaggtgcaggcgtggtgggaggtcgggtgggggaggtcgttcggtcccgaggtcccgggttcgggggggtccccttaggacggtaccttccgtcccgtggtcgccgacgtccctcgtgtacttcctaccctttntagttaatttatgtctagtcgacgtaccggtcgggtacccgccgacggtccgtaccggaggggtaacgggtacgtaggtaacttgtcgtctacgtaaggttaagttaagtaaggtaagtagaacgtaaataaagtattaattattaatacgtaactaactagtaggtaacggaagatactaacgtaccctactactaccgtaccggaaagtaacctaagtaaccaaagacgtacacgttagtacttactaaggaagtacgacacggtacctagagtcgacgtacggacgacgttacggcttagtacgtacgttaggtaggggtaggaggtacgggaagtaacggttaggtacgggtaggttacggggttaggccggggtaacggacggg

SEQ ID NO: 267311 - DNA, 755 bp, Homo sapiens
  misc_feature: GYAE6OF01AULE3.28.57.F02.1.454.CMB.1.raw
  modified_base (193)..(193): a, c, t, g, unknown or other
  misc_feature (193)..(193): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggtagtttgggctgagtcgttgggtttccttgttgtcttatttttaaggtgtcctagttgtgngtgcagtcgtggtggagtcggtgggggtggtcgttcgggtccgaggtcccgggttcgggggtcccctggacgtaccgttccttccgtggtcgccgtacggtcccttcggtcggtacctttccgttaacccgtttacgttaagttttaattttacgtcggttactacgttcgtccgtaccggttcgggtccccgtcggtaccggtcccgtaccgggaaggggtaacggtacgtaggaattagtcgtacgtagtaagttaagttaacgtaagtacgtagacgtaaataagtataattattacacgtaactaacgtgtacggtaggaacggtatacgtactaccactacgtccgtaacgaacgtacaacgtaacgaacgaacctctactagtactactaagagtaccgacgccgaacgtaggacgtcggtaacgacggtaccgtacgttacgttagttaacgttacgttacggtagggtagggtacgttaaggggaccggtttaaggtaacggttacgggtaacggttacgggggttccggacggggtacggaacgggttcccgg

SEQ ID NO: 267312 - DNA, 857 bp, Homo sapiens
  misc_feature: GYAE6OF01EL6PT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttattttaaaggtgtccagtgtgaggtgcagctggtggagtcggtgggggaggtcgttcggtccagtcccgtggggggtccctgagacctctcctgtgctacgcctcgtggtacttccaccgtttcaagttatttacgtgtactatgacctacggtcgggtcccgacgacggtcctaccggaagggggaacgggtacgttaggaaacgttacgttggtaccttacgtaaggttaagtttaaaggtaaagttaacgtacggaaccgtaaaattaaacctaaattaattaaagtttaacgtacgtaaccttaaaaaccgttccggttaagggtaaacgggtaaagggtaccgtaaaggtacctttaacccgaaccctaacgttccccgttaacccgaaacggggtaaaaccttaaaccgttaacccgaaaaacggtaccctaaccgggtttcttaaacgttttacctttacccgttaaagaaaccgggttcggaaacccgtaccggtaccgtagggaaacgttaccggtaccggtaagggaacccggtacgtaacccgggttgttaaagttacggttaacgttacgggtagggttaacgggggaaacgtaggggtaaacggtacgggttaaaacggttcggggtaaaaccggtttggggggttaccgggaacgggggtcccggtaaaccggggg

SEQ ID NO: 267313 - DNA, 819 bp, Homo sapiens
  misc_feature: GYAE6OF01DBFB1.28.57.F02.1.454.CMB.1.raw
  modified_base (222)..(222): a, c, t, g, unknown or other
  misc_feature (222)..(222): n is a, c, g, or t
tcagagtacgctatcacgaccggtgctcgatttagctcgatatagttgggtctgggagaggacgcccccgccctgggtttcccaggttgttctcatttggtgatcagcactgcacacaagaagagtcatggacggtagtttgggctgagtcgttgggtttttccttgttgtacttaagtttttaaaggtgtcctagttggtggaggtgcagtcgtgggtggngtcggtgggggaggtcgttggtccgacggtccggttcgggggtccctgacgtcctcctcgtgtgccgacgtcctcgtggtacttcctaccgtttcagttatttagtcgtctagtcgccgtaccggttccggtcccgccgtacggtccgaccgggaagggggaacggtacgtaggtaacttacgttcggttacgtacggtaaggttaagttaaaggtaaagtaacgttacgtaacgtaaaattaaactatttaaatttaagtttacgtaacgtaactaaacgttcgttaggtacggaaaggtactaacgtacgttacccactacgttacccgtaaccggaaaggtaaacctaacgtaaacctaaacggaaccctaccggtactttaacgtactttaaccctaaggtaaacggtccgggaaccgtaacggtcggttaacggaagggtccgtaaacggttggaaacccgggtaccgtacgttaccgttaggttaaacgttacgttacgggttagggaggggtaacgaagggtacgggttaggttaaacgggttacgggtaaacgggttggggtacccgggtaacggggtcgtaacggggg

SEQ ID NO: 267314 - DNA, 735 bp, Homo sapiens
  misc_feature: GYAE6OF01ALKGY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccaggccgtgggggtccctgagactctcctgtgcagcctctggacttccaccttcagttatttatgctatcgcctacggtcgggtccccgccgacggtcctaccgaaggggaagggtacgtaggaacttatgtacctacgtaggttaattaggtaaagttaagtacgaacgtaaataactaagttaattaatttatacgaactaaacttcgtaggtaggaagggctaagtactaccaacctactacccgtacggaacggtaaactaacttaacccgaaaggacctaccgtacttacgtaactaccgttaacgtaaaggtcgggtaactacggtacccgtaggaagtaccggtacggtaacgggaacggtaccgaccggtcgtttaaggttacgttaacgtttaccggtaggggttagggaagggtacgggtaaagggtaacggggttaaacggtttacggggtaaacgggtttaggggggttacggggtccgggggtaacccgggtaaccggggg

SEQ ID NO: 267315 - DNA, 867 bp, Homo sapiens
  misc_feature: GYAE6OF01CG7FU.28.57.F02.1.454.CMB.1.raw
  modified_base (426)..(426): a, c, t, g, unknown or other
  misc_feature (426)..(426): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggagcttggtccaggccgtgggggtccctgagactctcctgtgcacgcctcgtggtacttccacctttcagttatttatgcttatgcacgtcgggtcccgaccgacggcctccgaaggggtaaacgggaccgtagggaaacttagtggtctacgtaaggttaatttaaggaaagttaagttcggaacgtaaaataaacgattaattaatttaanacgtacctaaaacgtttccgtaggtaacggaaaggggtacctaaggtaactttacccgaaccctaacgttacccgttaacccggaaacggggttaaaaccctaaaccgttttaaacccgaaaaacggtaaacccgtaaaccggttaccgtttaacgttaaacgtttaccctttaaacgtaaaacggtttacgggggaacctaaccgggtaccgttacgggtaaacggtacggtaaccggttagggaaaccgggacccggaaacgggtttacccgttaaggttaaactttaaacggtttaaccgggtttaggggtaacggggggtaaagggtaaacgggggtaacggtaaacggggtttaaacgggtttaaacggggtaaaccggggttttaaggggggtttcccggggttagggggggaaccccggtaaaccccggggggg

SEQ ID NO: 267316 - DNA, 641 bp, Homo sapiens
  misc_feature: GYAE6OF01B0RM8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtcccctgagactctcctgtgcacgcctctggattccaccttcagttatttatgctatgcacgtcgggtcccgccgaggcctccgaggggaacgggacgtaggaatagtcgtctacgaggttaattaaggaagtaatgagaaataaactataataattatcgacaaaccttgtagtagaagggtacagtacttacaaccctattccgtaccgacgggtaacctaacttaccaaagtaaccacgtactagttactacttaactaagtcgggacagtacctagagtacgacgtaggaggaccgacggtcgttagttagtaagttacgtgggtaggggaacggagggtagggaaccggttaagttacgggtaacggttaaggggttgggtacgggggccggtaacggggg

SEQ ID NO: 267317 - DNA, 837 bp, Homo sapiens
  misc_feature: GYAE6OF01CO8RF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttaatttttaaaggtgtccagtgtgaggtgcagcgtggtggagtcgtgggggaggcgttggtccacggccggtggggggtccctggacgtacctctccgtggtgccaggtcctcgtggtattcccaccttcgagttatttatgtctatcgtctacgttcggggtcccgccgtacggcccgtaccggaaggggaacgggtaccgtagggtaaacttagttcgttaccgtacgtaaggttaattaaaggtaaagttaagttcggaacgtaaaataaacgtaatttaagtttaattaaacgtcgtaaacctaaaaccgttttcttaagggtaacgggtaaaacggggtaccgtaaggtttaaccgtttacccaaacccgttaaccgtttaccccgtaacccgggtaaaccgggttaaaacctaaaccgtttaaaccccgaaaacggtaaccgtaaaccggtaccgtttaccgttaacgttaaccgtttaaacgtaaacggttacgggacccgtaacgtaccggttaaggacgtacggaccgttaggaacgggacgtacggtacgttacgttaaagtttacgtacgggttagggtagggtaacgggaagggtaacggagggttaaacggttcgggtaaacgggttggggttaacgggtcggggtaccggtaacgggg

SEQ ID NO: 267318 - DNA, 747 bp, Homo sapiens
  misc_feature: GYAE6OF01CFP4M.28.57.F02.1.454.CMB.1.raw
  modified_base (654)..(654): a, c, t, g, unknown or other
  misc_feature (654)..(654): n is a, c, g, or t
  modified_base (680)..(680): a, c, t, g, unknown or other
  misc_feature (680)..(680): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggtcgttggtccagccggtcggggggtccctggacgactctccgtgtagcaggtcctcgtggtacttccaccgttcagttatttatgcgtatggcctacgttcgggtcccgccgaggtcctaccgaaggggaacggtacgtagggtaaatacgtgttcctcgtagggttacttaaggaaggtaactggaaccgaaaattaacaagttaacgttaacttagtaacggtaacctaaaacttcgttacgggtaggaacggggactaaggtaccctctaacccgatttcccgtacccggaagggtaaaccctaatttaccccggaaagtaacccgacggtacttaggtaacttacttacgtaaacggttcgggaactacgggtaccctagggtaacgacggtccgtaacgggaacggtacccgtaccgggtattaggttaaaccgttnttaacccggtgggttagggggaacgngggtaacgggtacgttaagggttacgggaaacgttagggggtcggtaccgggggtccgaacgggggg

SEQ ID NO: 267319 - DNA, 762 bp, Homo sapiens
  misc_feature: GYAE6OF01AEZ9E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccggtcggggggtccctgagacctctcctgtgcagcctgtggactttccgacctttcgtaagtttacttttatcgtactagttcgaccgtacggttcgggtccccgccgaacgggtccctacccggaagggggtaacggggtaccgttagggtaaattacgttcgttaccgtaggtaaggttaagttaaggtaaagttaagtacgaacgtaaaactaaactaagttaaatttattaatacgtaactaaactttcgttaggtaacggaaacgggtcctaaagttaccttaacctaaccctaacgttacccgtaccggtaacggtaaacctaacttaaccgaaacgtaacccgacgtctaagtacttacgttaacgaaggtccgggactacgtacctaggacgtacgtaccgaggtaccggaacgtacggtcgttagttaagtaaggttaccggtgggtacgggaaggtagggtaacggtacgggttaaacggttagggtaacgggttaggggttgggtaccggggtcggtaacggggg

SEQ ID NO: 267320 - DNA, 825 bp, Homo sapiens
  misc_feature: GYAE6OF01A4FXI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtcctagtgtgaggtgcagcgtggtggagtcgtgggggagtcgttcggtccgaggccggttcggggggtccctggacgtacttccgtccgttgtcgcacgtccctcgtcggtacttcctaccttactaacgtttattttatcgtactaagtcgacgtaccggttccgggtcccgaccgacgggtccgtaccggaaagggggtaaccgggtacgttaagggtaaattacgttcgttaccgttacggtaaggtttaaagtttaaggaaaagtttaaggtaacggtaacgtaaaacgttaactaaatttaaagtttaatttaagtaacgtaaacttaaacgttcggttagtaacgggaaacggtacgtaacgtacgttacccaacccgttaacttacccgtaaccgtaaacgggtaaacttaaaccgttaaacccgaaaacggttaacccgaaccgttacgttaacgtttaccttaaccggtttaaacgaaggttccgggaacgtacgtacggtacggaagtaccgaggttacggaacgaacggtacgtcgtaagttacgttagttacggtcgggtagggaacggtagggacggtagggtaacggttacgggtaaggttacgggggttggtaccgggggtacggtacggg

SEQ ID NO: 267321 - DNA, 622 bp, Homo sapiens
  misc_feature: GYAE6OF01BPI5C.28.57.F02.1.454.CMB.1.raw
  modified_base (518)..(518): a, c, t, g, unknown or other
  misc_feature (518)..(518): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggagtcttggtccagccgtgggggtccctgagactctcctgtgcagcctcgtggattcacctttcagttatttatgctatgcacgtgggtcccgccaggcctccgaagggaaggctaggaatatgtctcaggtattagaagtatgacgaataacatataatatgacaaactctaggtaggaaggcaagtacttcaacctatccgtaccgaagggaactaacgtacccaaaagacctacgtactagttaactccttaacgaaagtcgggactacgccgtagacgtacgcgttaggaacggacgtacggnttagtagttacgttaacgtgggtaggggaaggacgggtaacggtacgggttaacgttacggggtaaacgtttagggggttcgggtggggacccggtaacggggg

SEQ ID NO: 267322 - DNA, 589 bp, Homo sapiens
  misc_feature: GYAE6OF01D2RBK.28.57.F02.1.454.CMB.1.raw
  modified_base (384)..(384): a, c, t, g, unknown or other
  misc_feature (384)..(384): n is a, c, g, or t
  modified_base (477)..(477): a, c, t, g, unknown or other
  misc_feature (477)..(477): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggattcaccttcagttatttatgcttatgctacgtcgggtcccgccgacggcctccgaaggggaagggactggaatagtgtctcgagttaattagaagtaatgacgaataacatatattanagacaactctagtagaggcagtattcactatctcgaaggacaagtacaagaacacgtctagtactcttaacaagtcggacacgtacctggaangtactaggacggacgacggtacttagtaattagttacggtgggtagggaggagggacggtagggtaaacgttagggaaacggttagggggttcggcggggcggtaacggggg

SEQ ID NO: 267323 - DNA, 689 bp, Homo sapiens
  misc_feature: GYAE6OF01E37S8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccaggccggtcggggggtccctgacgactcctcctgtgcagcctgtggattcaccttcagttatttatgtctatgctacgtcggggtcccgccagggcctaccggaggggaaacggggtaccgtagggtaaattagttcgttctacgtaagggttaattaacggaaagttaagtaggaacgtaaataaacattaattaatttatacgactaaaactcgtagtaggaagggcaagtacttcaaccatcctaccgaagggaacctaacgttaccgaaacgaaccgaacgtctagtactacttaacaaggtcggacacggtacctaggacggacgacgtaggaaccgggacgaccggtcgtagttaactacgtttaacggttcgggtaggggaaggaacgggacggtaacgggttaaggttacgggtaacgggttaggggtttacgggtacgggggccggtaacgggggg

SEQ ID NO: 267324 - DNA, 1044 bp, Homo sapiens
  misc_feature: GYAE6OF01B7IXT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggagtcgttggtccagtccggtcgggggtccctggacgtacctctccgtgtcgcgacgtccttcgtggtacttcctacctttacgtaagttaacttttaagttcgtacgttaacgtcgtacgtaccccccccccccggttggggttccccggtacccggtaaccgggtacccgttaacccgggaacggggggtaaacggggtaaccggttaaggggtaaaacgtttaacggttacggtttacccgttaacggtaacgggtttaaacgtttaaaagggtaaaacggtttaaaacggtacggtaaaccggtaaaaacgttaaaacgttaaagtttaaacgttttaaacgttttaaacgttaacggtaaaacccgttaaaaccgttaacggtttaacggtaacgggtaaaacgggtaaccgttaaaggttaaccgtttaacccgtaaacccgtaaccgttaaccccggttaaacccgggtaaaccgggtaaaacccgttaaaaccgttaaaccccgtaaaaccggtaaacccgtaacccgttaccgtttaaccgttaaaccgtttaaccgtttaaaccgttaaacgggttaccggggtaaccgtaaccgggtaccggttaacgggtaacgggtaaccggttaacggtaacgggtaaccgggtaaccggtaaccgggtacgtttaacggtttaaaccgtttaacgtttaacgggttacggggtaaggggtaacgggtaacggggtaacgggtaaacgggttaacgggtttaaacgggttaacggggtttaagggggttaacgggggttacccgggggtaaccgggtaaccggggg

SEQ ID NO: 267325 - DNA, 865 bp, Homo sapiens
  misc_feature: GYAE6OF01EB29R.28.57.F02.1.454.CMB.1.raw
  modified_base (199)..(199): a, c, t, g, unknown or other
  misc_feature (199)..(199): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggtttttccttgttgtcttatttttaaaggtgtcagtgtgaggtgcagngtggtggagtcgtgggggagtcgttggtccaggccgtcggggggtccctgacgtactctcctgtgcacgtcctcgtggtacttcctacctttctaagttattttatcgtcttagtcgacgtaccggttccgggttccccgacccgacgggtcccgttaaccgggaagggggtaaacggggtaaccgttagggtaaatttagttacggttacccgttaacggttaaggtttaaagtttaaaggtaaaacggttaaagttaacggaaaccgttaaaaattaaaccttaaatttaatttaaacgttttaagtaaccgtaaaccttaaaaccgtttcggtttaagggtaacgggtaaacggggtaactaacggtttaaccttaacccaaccccttaacgttacccgttaaacccgggaaacggtaaacctaaaccttaaacccgaaaacgtaaccgtaacgttcgttaacgttacttacccgtttaactaaacggggtcgaaccgtagtacccggtaggaacggcgtacgggtaagtaaccgggactaccggtattacggttattaacggtttaggtaggggttagggacggtaaaggggacgggtaagggttaacggttagggttaaacggggttaggggttccggggtacggggccggtaaccggggg

SEQ ID NO: 267326 - DNA, 715 bp, Homo sapiens
  misc_feature: GYAE6OF01ERSHU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccaggccgtggggggtccctgagactctcctgtgcagtcctcgtggtacttcacctttcagttatttatgctatgcacgtcgggtcccgcgaggcctaccggaggggtaagggactaggaattagtgtctacgtaggttaattaaggaaagttaagtaggaacgtaaataaactaagttaattaatttaactacgtaactaaaactcgttaggtaggaaacgggtctaaggtacttacccaacctaacttacccgtaccggtaaacgggaacctaaactttacccgaaaacgtaacccgtacgtaccttaagttaccttacttaacctaaagggtcggtacgtaacggcccgtaaggtaggacggtcgtacggaacggaccgtaccgggattaggtaacttaaggtttacgtaggggtaggggaaggagggacgggtagggttaagttacgggtaacgggttagggggtttgggccgggggtcggtaacggggg

SEQ ID NO: 267327 - DNA, 916 bp, Homo sapiens
  misc_feature: GYAE6OF01D27I0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggtttttccttgttgtcttatttttaaaggtgtcagtgtgaggtgcagctgggtggagtcggtgggggaggtcttggtccgaggcccggtcggggggtccctggacgtacctcctcctggtgcacgtccctcgtggtacttcctaccgtttctagttatttactgtccttagtcgtacctaccggttcggggttccccggacccgtacggggtcccgttacccggggaaaggggggtaaacgggggtaaccgttagggtaaacgttacgtttacgggttcccgttaacggttaaagggtttaaagtttaaaaggtaaaacggttaaagttaggaaaccggtaaaaacttaaactaaagtttaaatttaatttaagtacggtaaacctaaaccgttcggttaaggtagggtaaacggggtactaacggttactttaacccaaccttaccgttaacccgtaaccggtaacgggtaaaccttaaacttaaaccccgaaaacgtaaaccgtacccggtactttaacgttaacgtttaaccgtttaacttaaaacggtcggggtaacctaccggtaccgttacgggaaggtacggtaccgtacggggtaaccgacggtaacgtacggtttaacgttaagttaacgtttaccgggttggggttaaggggaacgggttaacggggaagggttaaacccggttaaagggtttaaccggggggttaaaggtttagggggggttttcggggaaaccgggggtcgggtaaccgggggg

SEQ ID NO: 267328 - DNA, 717 bp, Homo sapiens
  misc_feature: GYAE6OF01AZZDB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagtgtgaggtgcgagctggtggagtcgtgggggagtcgttggtccaggccgtgggggtccctgagacctcctccgtgtcgacgcgtcctcgtggattccgaccctttctaagttatttacgtggtactagtgactacgttcgggtccccgcgtacggccttaccggaggggaacggtacctggtaaactagtcgtccgtagtaggttaattaagtaattaagtgtacgtaaaataactaattaatagttagtagtaacctaaacgttccgttaggtggaaacggcgtaaacgtacttacccgaactaacgttccgaccgaacgggtaaactaacgttaccaaaggacctacgtctagtataccgttaagaacgtccggatacggaccgttacgaggtcgtacgtagggaacggtaccgacggttccgtagttaaaccgtagttaccgtaggggaggttagggaaaccggttgggttaaccggaaaggttttacgggaacgtttaggggttacgggtcggggtaacggtaacgggg

SEQ ID NO: 267329 - DNA, 812 bp, Homo sapiens
  misc_feature: GYAE6OF01D7HEW.28.57.F02.1.454.CMB.1.raw
  modified_base (215)..(215): a, c, t, g, unknown or other
  misc_feature (215)..(215): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttggttttccttgttgcttatttttaaaggtgtcagtgtgaggtgcagctgggtggagtcgtgggggngtcgttggtccaggccggtggggggtcccctgacgtcctctccgtgtgcgacgtccttcgtggtacttccaccttcgtaagtttatttatgtcttagtcgctacggttccgggtcccgaccgtcgggtcccttaccggggaaggggaacgggtaccgttagggtaacttagttcggttactacggtaaggttattaaggtaataagtcgaacgtaaactaatattaattaattagtacgaactaaacgttgtaggtaagggaagggtactaagttaccttcccgaacctaacgttcccgtaacgggaacggtaaacctaaccgttaaccgaaacgtaacctcggttactaagttaccttacgtaagaacggttcgggaactacggtaccgtaaggtacggaccgtttagggacggtaaccgggtaaccgtccggttagttttaacggttaacgttaaccggtttagggttagggggtaaggggaacgggtaacgggaaaccggggtttaaagggttaaacgggtttttaacgggggaaaacgggggtttttggggtttaccggggggaacccggggggttccggttaaaccgggggg

SEQ ID NO: 267330 - DNA, 883 bp, Homo sapiens
  misc_feature: GYAE6OF01B5QEH.28.57.F02.1.454.CMB.1.raw
  modified_base (212)..(212): a, c, t, g, unknown or other
  misc_feature (212)..(212): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggtgtccagtgtgaggtgcagcgtggtggagtcgtgggggngtcgttggtccaggccgttgggggtccctgacgctctccgtgtcgcgagtcctcgtggacttccacctttcgagttattttatcgtctagtcgcacgttcgggtacccgccgaacggtccttacccggaagggggtaaacgggaccgttaggggtaaattacggttcggtttacccgtacggttaaaggttaagtttaaagggtaaagttaaacgttacggaaaccggttaaaaaacttaaaacggtaaagttttaacgtttaaaagttttaacttaccggggtaaaacccttaaaaaaccgtttccggtttaagggttaaaggggtaaacggggaccctaagggttaaacctttacccgaaacccgttaaccgttacccgttaacccggtaaaacggggtaaaccttaaaccgtttaaacccgaaaacgtaacccgtaacgttacgttaaacgtttaaccgtttacgttaaacccgtaaggttaccgggtaccgaaccgttacccggtaggtaacgtacggtacggtaacgggacggtaccgtacggtaccgttaggttaagttacgtttacggtagggttaggggaaggtaacgggtacgggtaacgttaagggttaacgggtaacgtttaggggggttagggtaccgggggtccggtaaacccggggg

SEQ ID NO: 267331 - DNA, 788 bp, Homo sapiens
  misc_feature: GYAE6OF01C7C6U.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtccagtgtgaggtgcagcgtggtggagtcgtgggggagtcgttggtccaggccggtcggggggtccctgacgaccttcgtccgtgtcgcacgccttcgtaggtacttccgtaccctttacgtaagtttacttttagtcgtacttagtcgccgtaccggtcggggtcccgccgacggtccgtaccgggaaggggaacgggtacgtaggtaattagttcgttcgtacggtaaggttaagttaagtaaagtaagtacggtaaacgtaaaattaaacgtaattaactttaagttagtacgtaaacctaaacgttcgtaggtaggaacgggtactagttacttaccaccgttactcccgtaccggtaaacggtaactaacgttaaccgaaacgtaaccgtaccggtacttacgttaacttaccgttaacgtaacggtacgggtactacggtaccgtaggtacggtaggtcgtaacgggaacggtacgtacggtgttaagttacgttaacgttcgggtagggtaggggaaggtacgggtaacggtaacgggttaaggttacgggttaaacggggtttggggttacggggtcggggtaccgggtaaccggggg

SEQ ID NO: 267332 - DNA, 570 bp, Homo sapiens
  misc_feature: GYAE6OF01CYM1R.28.57.F02.1.454.CMB.1.raw
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (383)..(383): a, c, t, g, unknown or other
  misc_feature (383)..(383): n is a, c, g, or t
  modified_base (555)..(555): a, c, t, g, unknown or other
  misc_feature (555)..(555): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctggagactctcctgtgcagcctcgtggattccgaccttcagttatttangctatgcacgtgggtccncgaggctaccgagggaacgggactagggaatagtgtctacaggtataagaagttaatgagaaataacattataattangactaactctgtagaagggcagatacacatcacgaggactaacttaccaagtaacacgcttagtactacttactaatcggacaacgcctaggagacgcgtagaggacagctagtatagtacgtggtagggaggaggaggaggtaacgttagggtaacggtagggttacgggnggggcggtaacgggg

SEQ ID NO: 267333 - DNA, 804 bp, Homo sapiens
  misc_feature: GYAE6OF01CEJMU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggaggcgttggtccacggccggtcggggggtacccctgagtactctcctgtcgcacgtcctcgtggtacttccaccttctagttatttatgtctatgcgtacgtcgggtcccgaccgacggccgtaccggaagggggaacgggtaccgtagggtaaattacgttacggttacctacgtaaagggttaatttaaaaggtaaagttaaacgtagaaacgtaaaattaaactaaagttaatttaatttaacgtaggtaacccttaaaacgtcggttacgggtaaagggtaaacggggtacctaaagtaacccgtttaacccaccgttaacttcccggtaaccggaaacgggtaaacctaaacgttaaacccgaaagtaacctaccgtacgtttaacgttacgttaacccgttaacgaaaacgggtcggacctacgtaccggtggacgtaccggtcgtaacggaacggtaccgtacggtccgtaagttacgttaaggttcggtagggtaaggggagggaacgggtcgggtaaacggttaaggggttaacggaacggggtttggggtaacgggtacgggggcgggtaaacccgggg

SEQ ID NO: 267334 - DNA, 758 bp, Homo sapiens
  misc_feature: GYAE6OF01DRUO5.28.57.F02.1.454.CMB.1.raw
tcagagtacgctatcacgaccggtgctcgatttagctcgatatagttgggtctgggagaggacgccccccgccctgggtttccccaggtgttctcatttggtgatcagcactgcacacagaagagtcatgacggtagtttgggctgagtcgttggtttttccttgttgacttaagtttttaaaggtgtcctagtgtgaggtgacgagcgtggtggagtcggtgggggagtcgttcggtccacggtccggtcgggggtccctgagccttcgtccgtgtcgcgacgtcctacgtggtacttacctacccgtttgaagtttatttagtcgtaccttagcgtccgaacggttcgggtaccccacgacggtccgtaccggaagggtaacggctaaggtaactagttcgacgttacggaaggttaattaaggtaaaataccgtagtaaacgtaaaactaagtattaattactaagtacaacgtaaactcgtaggtacggaagactagttactaccaactactaccgtacgaaacggtacctaaacgttacccaaaggaacctacgtacttacgtaacttaccgtaacaaggtaccggacgacgtaccgaggacgaggtacctacgggaacggtccgaaggtaccgttaagtaccgtttaaaggttacggttacgggtaagggtaaaccggtagggaaaccggttacgggttaaggttaacgggtaacggtttacgggggtgggtacggggaaccggtaacgggg

SEQ ID NO: 267335 - DNA, 559 bp, Homo sapiens
  misc_feature: GYAE6OF01CBYL0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattcaccttcagtatttatgctatgcactgggtccgcaggctccgagggaaggactggaatactgtctcaggtattagaagtaatgacgaataaacatatattatgactaaactctaggtgaaagggcaagtattacaaccattacctccgagggaacaaattcccaaagaacacgctagtacttcttacaaagtcgggacagcccgtgaagtagctggaacggacacggtctagtataattacgtgtagggagtaggagtcggaagttggaacgttaggggttgtggggcctaagggg

SEQ ID NO: 267336 - DNA, 644 bp, Homo sapiens
  misc_feature: GYAE6OF01CP7IJ.28.57.F02.1.454.CMB.1.raw
  modified_base (411)..(411): a, c, t, g, unknown or other
  misc_feature (411)..(411): n is a, c, g, or t
  modified_base (537)..(537): a, c, t, g, unknown or other
  misc_feature (537)..(537): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtcagtgtgaggtgcagctggtggagtctggggggaggcttggtccaggccgtgggggggtccctgagactctcctgtgcagcctctggattccacctttcagttatttatgcttatgcctacgtcggggtcccgccgaggccgtacccgaagggggaaggacgtggaaattagtcgttctacgaggttaattaaggaaagttaatgaacgtaaataacgtattaattaatttanacgaactaactcgtaggtaggaagggacagtaattcactactctacgaggtacaactaccaagaacacgtctagtactacttacaagtcgggacagacctaggacgcgcgtagacggacctacggnttagtacttagttacgtagggtagggtaaggacgggtaggtaccggggttaaagttaggggtaaaaccggtttgggggtttacggcgggggggcccgtaacgggggg

SEQ ID NO: 267337 - DNA, 683 bp, Homo sapiens
  misc_feature: GYAE6OF01C24T2.28.57.F02.1.454.CMB.1.raw
  modified_base (501)..(501): a, c, t, g, unknown or other
  misc_feature (501)..(501): n is a, c, g, or t
  modified_base (658)..(658): a, c, t, g, unknown or other
  misc_feature (658)..(658): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcttgggtccaggccgtgggggggtccctggagactctcctgtgcagcctcgtggtacttccaccttcagttattttatgctatgacacgtggggtccgccgaggctaccgaagggggaacgggactggaatatgtctacgaggttaataaggaagtaatgacgtaaataaacattaattaattatacgaactaactcgtaggtaaggaagggtactagacttccaactactccgtaccgaaggtacctaaacttacccaaagaacctacgtaccttagtaccttntaacgaaagtcgggacgaagccttaggacgtacgtcgtaggaacggtacgaccgggttattacggtaattaaggttacgtacgggggtaggggaaggtaaggggcgggtaagggttaaacgggttcgggttaaacgggttaggggggtttaccgggngggggggtacccgtaaacggggggg

SEQ ID NO: 267338 - DNA, 602 bp, Homo sapiens
  misc_feature: GYAE6OF01CN71T.28.57.F02.1.454.CMB.1.raw
  modified_base (344)..(344): a, c, t, g, unknown or other
  misc_feature (344)..(344): n is a, c, g, or t
  modified_base (386)..(386): a, c, t, g, unknown or other
  misc_feature (386)..(386): n is a, c, g, or t
  modified_base (397)..(397): a, c, t, g, unknown or other
  misc_feature (397)..(397): n is a, c, g, or t
  modified_base (515)..(515): a, c, t, g, unknown or other
  misc_feature (515)..(515): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccaggccgtggggggtccctgagactctcctgtgcagcctctggattccacctttcagttatttatcgctatgccacgtcggggtcccgccgaggtcctccgaaggggaagggactgggaatntgtctcaggtataagaagtatgacgaaataacattatattanacgacaacttntaggtggaagggcaaggtacttccgacctatcctaccgaggaacctaattaccaagaaccacgctagtactactacaaagtcggacagccgtagagtagctagggaacgtcgacggtntagtacttagttacgtgggtagggagtagggaggacggttaaggtacgggaaccggttaggggttcggtcggggtaccggacggggg

SEQ ID NO: 267339 - DNA, 728 bp, Homo sapiens
  misc_feature: GYAE6OF01BZCPP.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctctggtattccacctttcagttatttatgtctatgctacgtcgggtcccgccgaggcctaccggaaggggaacgggacgtagggtaattagtcgttccgtacgtaagggttaattaaggaaagttaagtgaacgaaataaacaattaattaatttaatacgaactaaaacgttcgtggtaggaaagggctaaggtaacttaccaacctatacctaccggaacgggtaactaacgttaaccgaaacgaaccgaccgtactagttacttaccgttaacgaaaggttcgggaacctaccggtaccgtaggaacgacgtaccgtaacggacgggaacccggaacggttccgttaagttaacgttaagtttaccggtggggtagggaacgggtaagggacggggtaaacggttaacgggttacgggtaaacgggtttagggggtacgggtacgggggaccgggtaacgggggg

SEQ ID NO: 267340 - DNA, 990 bp, Homo sapiens
  misc_feature: GYAE6OF01DEZX2.28.57.F02.1.454.CMB.1.raw
  modified_base (888)..(888): a, c, t, g, unknown or other
  misc_feature (888)..(888): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaatttttaaaggtgtccagtgtgaggtgcagcgtgggtggagtcggtgggggaggtcgttcgggtccaggcccggtcggggggtcccctaggacgtaccttcctccgtggtagccgacggtcccttcggtaggtactttaccctaaccctttcgtaagttttaagtttttaactcggtaccttaagttccggtacgtaaccccgggttccgggggttaccccgacccgtaaccgggtaccccgttaccccggggaaaggggggtaaaaccggggtaaccgtaaggggttaaacttacggttcggtttaacccgtaacggttaagggtttaaagtttaaaacggtaaaaggtttaacgtaccggtaaaacggttaaaaacttaaaccttaaagtttaaaatttaaagtttaaacgttacggtaaacccttaaaaccgtttacgtaagggggttaaacggaaacggggtaccgtaaaggttaaccctttaacccgaaccccgtttaaaccggtcccgttaaacccggggaaaccgggttaaacctttaaacccgttaaaacccgaaacggtaaacccgtagtacccgtttaagttaactttacccgttaaagaaacgggttccgggaactcccggggtactacggggaacgttacggaccgttaacgggaacgggttacccggaacggtttacgtagttaaaccgttaagtttaaccgggngggggttaacgggaaagggttacgggaacgggttaacgggtaacggttaccggttaaaacggggttggggttacggggtaccgggaaccggggtaaccgggg

SEQ ID NO: 267341 - DNA, 808 bp, Homo sapiens
  misc_feature: GYAE6OF01C8HH6.28.57.F02.1.454.CMB.1.raw
  modified_base (180)..(180): a, c, t, g, unknown or other
  misc_feature (180)..(180): n is a, c, g, or t
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagtcgttgggttttccttgttgcttattttaaggtntccagtgtgaggtgcagcgtggtggagttcgtgggggagtcttgggtccaggtccggtcggggggtcccctaggacgtaccttcctccgttggtgcctacgccttcgtggtacttcctacctttctaagtttactttatgtctatcgactacggtccggtccgccgacggtcctaccggaggggaacggtacgtaggtaatagtcgttctagtaggttaattaacgaagtaaagtgaacgtaaataactaattattaattnaacgtacaacttgtaggtacgtaacggctaaggtacctaccgtaaccctcgttacccgtaaccggtaacgtaaaccgtaaacgttaacccgaacgaacccgttaggtaccttaacgttaacctttaccgttaaacggtaagtaccgggactaaccgggtaccgttaaggaacggtacggtacggttaacgggaaccggtaccgtaccgggttaccgtttaaggttaacccggtttaagttaccggggtttaacggggaggggttaaacgggtaacggggtaacggggttaaaggtttaaacggggtttacgggtaaaacggggttttgggggttacggggtcccgggggttaacggggaccccgggg

SEQ ID NO: 267342 - DNA, 818 bp, Homo sapiens
  misc_feature: GYAE6OF01C0AAM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtaggtttgggctgagtcgttgggttttccttgttgtcttaagtttttaaaggtgtcctagtgtggaggtgcagtcgttgggtggacggttcggtggggggacggtcgttcgggtacccgacggtcccgggttcgggggggttacccctaggacgtaccttccgtccgtgtcgcgacgtccttcgtacggtacttcctacctttacgtagtttattatcggtctagtcgaccgtaccgtccggggtccgaccggtacggtacctaccggggaaggggaacgggtacgtaaggtaactagttcgttacgtagggtaagttaagttaaaggtaagttaaagtacggtaaacgtaaacttaaagtaatttaagttaattaacgtacggtaaccttaaaccgttaggttaaaggtaggaaacgggtactaaggtacttacccgaacttacgttacccgaaccggtaaacggtaaacttaaccgtaaccgaaacgaaccgtaccgtacttacgtaactttactaaggtaagtccgggaactaccggactacgcgttaaggccggagtaaccggtacggtacggtactaaggtacgttagttacgggtaggtacgggaagggacgggtaagggtaacgggtaggtttaaacgggacggggttaggttgggggtccggggtaacgggtaccggg

SEQ ID NO: 267343 - DNA, 568 bp, Homo sapiens
  misc_feature: GYAE6OF01AY4FS.28.57.F02.1.454.CMB.1.raw
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
  modified_base (519)..(519): a, c, t, g, unknown or other
  misc_feature (519)..(519): n is a, c, g, or t
  modified_base (553)..(553): a, c, t, g, unknown or other
  misc_feature (553)..(553): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggggtttggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtcccgccaggctccgaggggaaggactggaatatgtctcaggtattagaagtaatgacgaataacatatattatgactaaactcgtaggtagaacgggnagtacttcaccatcctaccgagggactaaacttaccgaaagaaccnccgacttggtaacttcctaacaaagtcggaccagcctagagagtcgagagacgacgctagtattactagtgggtgggagnggaggacggtaagttacggaaagttggggttagnggggccgaggggccg

SEQ ID NO: 267344 - DNA, 818 bp, Homo sapiens
  misc_feature: GYAE6OF01AIQT8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagtcgttgggttttccttgttgtctttaagtttttaaaggtgtccagtgtgaggtgcagtcgtgggtggtagtcggtggggggaggtcgttgggtcccgaggtcccggttcggggggttcccctggaacgtccttccgttccgtggtcgccgacgtcctcgtaggtacttccgtacctttcgtagtttaatttagtcggtcttagtcgaccgtaccggttcggggtaccccgaccggtacgggtacgtaccgggaaagggggtaacggacgtaggtaaactagttcgtacgtaacggtaaggtttaacgttaaaggtaacgttaagtacggtaaagtaaaaacgtaacgtaaatttaagtttaacgtttaagtaacgtaaccttaaacgttcggtaaggtaacggaacgggtactagttaaccttaccaacgtacctaccgtaacggtaacgtaaaccgtaacgtaaccgaaacgacctacgtacgttacgttactaccttaagacggttcgacgtaccgaccggtaggacgtaggtcgtacgtaaccggacggtaccgtaacgtttaggtaactttacgggtaccggtggggtaaggagggtaggtaacgggttacgtaaggtttacgggtacgggtttacggggtcgggttaacggggcccggttaacgggg

SEQ ID NO: 267345 - DNA, 890 bp, Homo sapiens
  misc_feature: GYAE6OF01CQ3BT.28.57.F02.1.454.CMB.1.raw
tcagagtacgctatcacgaccggtgctcgatttagctcgatatagttggggtctgggagaggacgcccccgccctgggtttcccaggtgttctcatttggtgactcagcacctgcacacagaagagtcatggacggagtttgggctgagtcgttgggttttccttgttgcttaatttttaaaggtcgtccagtgtggaggtgcgaggcgtgggtgggtaggtcgggtggggggacggtcgttcgggtaccgacgggtcccggttcgggggggttcccctaggacgtaccgttcctcccgttggtcgacgacgtccttcgtaggtactttccgtacctttacgtagtttaacttttatcgtaccttagtcggaccgtaccggtccggggttacccgcccggtaagggtcccgttacccgggaaggggggtaacgggtaaccgttagggggaaatttacggttacggtttcgttaaccggtaagggtttaagttaaagggaaacggttaaacggtcggaaaccgtaaaagttaaactagtttaaacttaagttaagtacggtaacctaaacgttcgttaggtacggaagggtacctaagtacttacccgacctacgtccgtacccgtaacgggtacctaaacgtaacccgtaacgaaccgtaacggtacgttacgtaacttaccttaacgtaacgtacgggtacgtaaccggtacgtaacggacggtacgtacgttaacgggacggtaccggtaccgggtacgttacgttaaacgtttaccgtagggttacggggtaagggaagggtaacgggtacgggtaacgggttaacgggttaacggggtaacggtttacgggggttacggggtacccggggtccgggtaaccggggg

SEQ ID NO: 267346 - DNA, 799 bp, Homo sapiens
  misc_feature: GYAE6OF01BUSAR.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagtcgttgggttttccttgttgtcttaatttttaaaggtgtccagtgtgaggtgcagcgtggtggagtcggtggggggagtcgttcggtccgacggtccgggttcggggggtcccctggacgtaccttcccgtccgtggtcgccgtacgtccttcgtacggtactttaccctaaccctttacgtaagtttaagttttacgtgtaccttagttcgtaccgtaccggttccgggtccccgaccgacggtcccgtacccgggtaaggggtaacggtacgtaaggtaatagtcgtaccgtgtaaaggttaattaaggtaagtaactgaacgtaaattaactaagttaattattaagtacgtaacctaaaccgttgttaggtaacggtaagggtacctaagtacttaacccgaccttaacgttcccgtaaccggaacggtaaacttaacgtaacccgaaaacgtaacctacgtaccttagttactttacgtaacgtaagtcggtacaccgtaccgtagacgggtactaggaacggacgtaacgtcgggttacgttagtaacgttaagtaacggttgggtaccggggaaaggtagggaccgtaaagggttaagttaacggggtaacggttaggggtacgggttccggggaccggtaacgggg

SEQ ID NO: 267347 - DNA, 907 bp, Homo sapiens
  misc_feature: GYAE6OF01BS5XB.28.57.F02.1.454.CMB.1.raw
  modified_base (811)..(811): a, c, t, g, unknown or other
  misc_feature (811)..(811): n is a, c, g, or t
  modified_base (829)..(829): a, c, t, g, unknown or other
  misc_feature (829)..(829): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacgggtagtttgggctgagtcgttggggttttccttggttgtctttaagtttttaaaggtcgtcctaggttggtggagggtgcaggcgtggggtgggaggtcggtggggggtaggtcgttgggtcccacgggtccgggttcgggggggtccctggacggtaccttccgtccgtggttcgacgtacggtccttacggttcggttaactttcccttaacccgtttacgtaaggttttaacgtttttaagtcggtacctttaagttcggtacccggttaccgggttccgggggttcccccgaccggaccgggtacccgttaacccgggggaaagggggtaacgggtaccgttaagggtaaactttagttacggttaccgtaacggttaaagggtttaaacgttaaaggttaaaagttaaacggtaacggtaaaccgtaaaaagttaaaactaagtttaaagtttaaacttttaagaccggttaaaccttaaaacgttcggttaagggtaaacgggtaaacgggtactaacgtactttacccgaaccttacgtaccgtaaccgggtaaaggtaacctaaacgttaacccgaaagacccgtacgttacgttacgtttacttaccgtaacgtaacggttcggacctacgtaccgtagggaacccgtgtacgtaggaaccggcgtacgtntagttagtacgttacggngggttaggacggtaaggacgggtaaggttaagttaacggggtagggttaggggtcgggtacggggtaacgtacggggg

SEQ ID NO: 267348 - DNA, 774 bp, Homo sapiens
  misc_feature: GYAE6OF01DWCZ5.28.57.F02.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
tcagagtacgctatcacgaccggtgctcgatttagctcgatatagttgggtacgtgggagaggagcccccgccctgggtttcccgacggtgttcgtacatttggtacgatcagcactgcacacagaagagtcagtgacggagttggctgagctggtttcttgtgctagttttaagngtcagtgtgaggttgcagngtggtggagtcgtggggagcttggtccaggccgtacgggggtccctggaaggtccttcgtcccttagtcgtcacgtccttccgtggtacttctaaccgtttcgaagttacgtttaacttcgacttacgtcggactagttcgggttcccgaccgtaacggtccttacccggaagggggtaaacgggtacgtacggtaaacgttagttcgttactccgtaaggttaacgttaaggtaacgtaagtcggaactaaagtaaactagttaataacttagtacgtactaaacgttcgtaggtaagaacgggactaaggtctttaaccgaaccgtacgtcgtaacccgaaagggtacctaaacgtttaaccaaacggtaactaccgtacgttacgttattaccttaacgaaacggttcgggtactaccggaccgttacggacccgtaggtacccgtaccgggtacgggtaccgtaaccggtgtttacgtaacgttaacgtttacggtagggttaacgggagtaacgggagtcggtaaacggttacggtaacggtttaggggttcggtcgggtacggtaacccgggg

SEQ ID NO: 267349 - DNA, 765 bp, Homo sapiens
  misc_feature: GYAE6OF01BZG8X.28.57.F02.1.454.CMB.1.raw
  modified_base (215)..(215): a, c, t, g, unknown or other
  misc_feature (215)..(215): n is a, c, g, or t
  modified_base (742)..(742): a, c, t, g, unknown or other
  misc_feature (742)..(742): n is a, c, g, or t
tcagagtacgctatcacgaccggtgctcgatttagctcgatatagttgggtctgggagaggacgcccccgcccgtgggtttcccaggtcgttctcagtttggtgatcgagcactgcacacagaagagtcagtgacggagtttgggctcgagtccttgggtttccttgtgtcttagttttaaggtgtccagtcgtgaggtgcagtcgtgggtgggnggttcggtggggggaggcgttcggtccgacggccgggtcggggggtccctaggacgtactctccgtggtgcacgtctgtaggtacttccgtacccttgtacgttatttactcgtacctagtcgacgtaccgtcggggtacccgaccgacggtcgtaccggaacggggtaaggaccggtaggtaatacgtagtcctacgtaggttaataaggtaagtaagttacgaacgtaaactaacgtaactaatttagtactagtaacccgtaagtcgtaggtaaggtaacggacgtaacgggtactaccgaacctatacgtacgtaaggtaactaactaacgtaacggaactcgtactcgttaactacgttaacgagggttaccggactaaccgggcgtaggaacggtgtacccgaagggtacccgtacgaaccggttctaacggttaaactaccgtagggtcgggaggggtaacgttacggggaacgggtttaaccgaagggtttacccggacgggtttagggggttaccggnggggggtaaccccgtaacggggg

SEQ ID NO: 267350 - DNA, 612 bp, Homo sapiens
  misc_feature: GYAE6OF01C4MJL.28.57.F02.1.454.CMB.1.raw
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (600)..(600): a, c, t, g, unknown or other
  misc_feature (600)..(600): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggctattttaaggtgtcagtgtgaggtgcagctggtggagtgtgggggagcttggccagccgtggggggtcctgganctctctgtgcagctcngattcactttcattatttatntctagtcgacgtcggtcggccacgacgtcgacggaagggacggngtaggatntcgtctagagttaatagaagtagtgacgtaataactattatattacgacgtaacgtaacttgaggtaggaacggtgtagtactaccaccgtactcgtacgaacggactaacgtaaacgacgaactacgtactacgtacttagtaacgtaacggtcggtacacgtacgaaggcgggtaacgtcggaggtaccggacgtacggtactaagtacgttacgtagggtcgggaagggaacggtagggaggtaggtaggtagggtagggttgggtacgggnggacggtacggg

SEQ ID NO: 267351 - DNA, 831 bp, Homo sapiens
  misc_feature: GYAE6OF01CZA5U.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccaggccgtggggggtccctgagactctcctgtgcagcctctggattcaccttcagttattatgctatgcacgtgggtccnccaggctccgagggaaggactggaatatgtctcaaggtattaagaacgtaagtggaacgtaaataacaattaagttaacttaagtacgtaactaaaaaccgtttcgtaggttaaggaaacggggtaccgtaaaggtaacttttaccccaaacccgtaaccgttaaccccgtttaaccggaaaccggggtaaaacccttaaaaccggtttaaccccgaaaaaccgggttaaaaccccgaaacccggggttaccttaaacgggtttaactttaacccgttttaacccgtaaaaaacgggttaccgggggtaaccgtaaaccggtacccggtttacgggaaacgggttaaccggaccgttacgggaaaccgggaccgtaaaccggggtacgttaacggttaaacgtttaacgtttaaccgggttaggggttagggggaaaggtaaggggaaccgggtaaccggggttaaagttacggggttaaaacgggttagggggtttaccggggtgggggtacccgggtaaaccgggggg

SEQ ID NO: 267352 - DNA, 885 bp, Homo sapiens
  misc_feature: GYAE6OF01DAD1P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggtttttccttgttgtcttaagtttttaaaggtgtccagtgtgaggtgcagctggtggagtcgtgggggaggtcgttggtcccgaggcccggttcgggggggttcccctaggacgacctcctccgtgtcgccacgtccttcgtggtacttccgtacctttcgagttattttatcgtacttatcgtctacggtcgggtcccgccgacggtccgtaccggtaaggggaacgggacgtaggtaaatacgttcgttacctacgtaaggttaagttaaaggtaaaggttaagtacggtaaacgtaaaactaaaacgttaattaagtttaacttaagtacgtaaacctaaaccgtttaggtagggttaacggtaaacgggtacgtaacttaaccgtttacccaaaccggttaccttaaccggtaccccggtaaacgggtaaccctaaaccgttaaacccggaaaaccgtaaccgtaaccgttactttaaccgtacctttaaccgttaaacgaaacggttccgggaacctaaccggtaccgtacgtaaacgggacgttacggtaacgggaaccggtaccgtaccggtaggtttaaccgttaagttaacgggtttaccggttagggggagggggtaaacggggtacgggtaacgggtaaacgggtttaacggggttaaacggggtttaacggggtttggggggtttaccggggaaaccgggggttcccggggtaaaacggggg

SEQ ID NO: 267353 - DNA, 711 bp, Homo sapiens
  misc_feature: GYAE6OF01A82J0.28.57.F02.1.454.CMB.1.raw
  modified_base (294)..(294): a, c, t, g, unknown or other
  misc_feature (294)..(294): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaggtgtcagtgtgaggtgcagcgtggtggagtcgtgggggagtcgttggtccagccgtgggggactcccgtggacgactctccgtgtcgcacgcctcgtggacttcaccttcagttatttangtctatcgcaccgtcgggtcccgccgacggccgtaccggaaggggaacgggtactagggaattagtgttctacgtaggttaattacggtaaataagtagaacgtaaataacgtaataagttaattagtacgtaactaaacgttgtacggtaggaaacgggtctaacgtacttaccgtacctagtacccgtaccgaacgggtaacaacttaacccgaaagtaacccgacgttacctaggttaacttcgttaaaccgtaaagtcgggaactacggtccgtaaggaccggaagacgtagggaaacgtccggaacggttcgttacgttaagttaccgtaggtagggtacggggtaagacgggtaagtaacgggtaacggtttaggaaaccggtttagggggttgggacgggtaacccgggg

SEQ ID NO: 267354 - DNA, 691 bp, Homo sapiens
  misc_feature: GYAE6OF01DFUGS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttatttttaaaggtgtccagtgtgaggtgcagcgtggtggagttcgtgggggagtcgttggtccagccgtcggggggtccctggacgactcctccgtgtcgcacggcctctggtacttccacctttcaagttatttatgtcttagtcgctacggtcgggtcccgaccgaggcctaccggaaggggaagggacgtaggtaatagtgtactacgtagtaaattagaaagtagtagagaaataaactattaatattaatgaacctaaatcgtggtaggaagggactagtacttcaaccctataccgtaccgaaggtaactaaacttacccgaaagaaccacgtattacgttaatttccttaacaaaggtcgggactaaccggtcgtaggacgtaggcgtaggaaggtacacggttcttaggtaacttaggtttaacgtggggtaagggtaacgggtaagggtaacggtaacgggttaaagttaacggggaaaggttacgggggttagggtccggggacggtaaccggggg

SEQ ID NO: 267355 - DNA, 791 bp, Homo sapiens
  misc_feature: GYAE6OF01CEC33.28.57.F02.1.454.CMB.1.raw
  modified_base (197)..(197): a, c, t, g, unknown or other
  misc_feature (197)..(197): n is a, c, g, or t
tcagagtacgctatcacgaccggtgctcgatttagctcgatatagttgggtctgggaggaggagcccccgcccctgggtttcccaggtgttctcatttggtgatcagcactgcacacagaagagtcatgacggagtttgggctgagcttgggttttccttgttgctatttttaaaggtgtccagtgtgaggtgcagntggtggagtctgggggaggcttggtccagccgtggggggtccctgagactctcctgtgcacgcctctggtattctaccttacagttatttatagtctatgccacgtcggtccgccgacgcgtccgaggggaagggacaggaatagtgtctacgtaggttaattaaggtaagtaacgtagacgtaaactaaactaatatttaattaatacgtaactaaacttcgtaggtacggaagggtacgtaagtacttaccaacctaacgttacctacccggtaacgggtaaccttaaacttaaacccgaaacgaaccgtaaaccgtccgttaacgtttaacttacccgtttaacgaaaacgggttaccgggtaccgtaacccggtacccggtaagggaacgggtacggttacccggtaaggtaaccggggaacccgtaaccgggtaccgttttaaggttaaccggtttaaacgtttaccggtttaaggggttagggggaaagggtaaaggggggaaccggtaagggggtaaaggtttaccggggtaaacggggtttagggggttacgggttaccggggggtaccccgggtaaaccgggggg

SEQ ID NO: 267356 - DNA, 574 bp, Homo sapiens
  misc_feature: GYAE6OF01AK9DT.28.57.F02.1.454.CMB.1.raw
  modified_base (172)..(172): a, c, t, g, unknown or other
  misc_feature (172)..(172): n is a, c, g, or t
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtcgtgggagaggagccccgccctggtttcccaggtgttctcatttggtgatcagcactgcacacagaagagtcatgacggagtttgggctgagctgggttttccttgttgctattttaaggngtccagtgtgaggtgcagctggtgagtctgggggagcttggtccagccctgggggtccctgagactctcctgtgcagcctctggacttcacctttcagttatttagtcgctatgcactgggttccgccaggctccgaggggagggctggaactatgtctcaggtattagaagtatggcgaataacattatacttangacaactctgtggaaggcagnttcaccatctccgagggacctaagttcccaagaaccacgctagtatcttacgaagttgggaccagtccctggagtacgcttaggacgacaccgggcttaggtaccttagttaccgtgggtggggaacgaggggacgaccgggtaattacgggaacgttggggtcggttggggcccgtaacggggg

SEQ ID NO: 267357 - DNA, 681 bp, Homo sapiens
  misc_feature: GYAE6OF01AY0ZP.28.57.F02.1.454.CMB.1.raw
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggagcttggtccagccgtgggggtccctgagactctcctgtgcagcctctggattcaccttcagttatttatgctagtgctacgtcgggtccgccgagcctccgagggaaggtactaggaatagtgtctcgaggttataagaagtangacaaataacatatattangactaaacgtctaggtaggaacggganacgtacttaccacctacgtcctacgaacggtaacctaacgtaccaaagaaccctaacggccttaacgtaattacccgttaagaaacgtcggggtacaacggtaccgtaggtacgtaacggtcgttaaggacgggaaccgtaccgggtacttcggtaaactttaaggttaccgtaggggttaacgggagggtaacggggacggtaacgggttaaaggtttaacggggtaacggggttttaaggggtcgggggtttccgggggacccggtaaacgggggg

SEQ ID NO: 267358 - DNA, 579 bp, Homo sapiens
  misc_feature: GYAE6OF01ANCJ8.28.57.F02.1.454.CMB.1.raw
  modified_base (368)..(368): a, c, t, g, unknown or other
  misc_feature (368)..(368): n is a, c, g, or t
  modified_base (453)..(453): a, c, t, g, unknown or other
  misc_feature (453)..(453): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtcccgccaggctccgagggaagggactggaatatgtctcaggtattagaagtatgacaataacatatattangactaaactctaggtaggaagggcaagtattccaacctatctaccgagggaactaacttaccaaagaaccacgctagtactctanaagtgggacagcctgagtacgtcgtaggacggacgacggcctagttactagttacgtgggtagggaggagggacgtacgggtaagttacgggtaacgttaggggttggtcgggggtcgtacggggg

SEQ ID NO: 267359 - DNA, 776 bp, Homo sapiens
  misc_feature: GYAE6OF01CLI4W.28.57.F02.1.454.CMB.1.raw
  modified_base (676)..(676): a, c, t, g, unknown or other
  misc_feature (676)..(676): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccaggccgtggggggtccctggagactctccgtgtgcacgtcctcgtggtacttcctacctttcagttatttagtgtcttagtcgtaccgacggttcgggggtccccgtacccgacggtcccgtacccggaaaggggggtaacgggtaaccgttagggtaaattacgttcgttaccgttacgtaaggttaagtttaaggtaaagttaagtacggtaacgtaaaaattaaactaagttaatttaaattaagttacgtaaacgtaaaccttcggttaaggtaaggaacgggtacgtaacggtaccttaccctaaccgtacttaccccgtaaccggaaacgggtaaacctaaccgttaacccgaaaagtaacccgtacggtactttacggtaactttaccgttaacgaaagtcgggactacgtaccgtaggacgtagacgtggaacgtacgacggtnttaagtatttacgttacgtgggtacgggtaaggaggtaacggtaacgggtaaggttacggggtaaacggttggggttacgggccggggacggtaacgggg

SEQ ID NO: 267360 - DNA, 700 bp, Homo sapiens
  misc_feature: GYAE6OF01BTGYO.28.57.F02.1.454.CMB.1.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtgcagcctctggattcaccttcagttatttangctatgcacgtcgggtccnccaggctccgaaggggaacggactaggaatatgtctcgaggtattagaagtatgacgtaaataactataattattatagactaaactcgtaggtagaagggctaaggtacttaccaacctaatcccgtacccggaaagggtaacctaaactttacccgaaagaaccacggtacttaggttaacttactttaacgaaagttcgggacctaacggtccctagggaacggacgtcgttaaggacggggtaccaaccgggtacttaacggttaaattttaacgttacggtttggggaaggggggttagaacgggggtaaggtacccggggttaaaagtttacggggaaaacgggttttaggggggtttacggggttccggggggaacccggtaacggggggg

SEQ ID NO: 267361 - DNA, 629 bp, Homo sapiens
  misc_feature: GYAE6OF01AM251.28.57.F02.1.454.CMB.1.raw
  modified_base (255)..(255): a, c, t, g, unknown or other
  misc_feature (255)..(255): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtctgggggagtcttggtccagccgtggggggtccctggagactctcctgtgcngcctctggattccaccttctagtatttagtgctatcgcacgtgggtccgccaggtcctccggaagggaaggcgtaggaatagtcgtctacgaggtattaggaagtaatcgacgaaataacatactattacngaacaactntgtagaggnagatacactatctacgaggtacaactaccaagaacctacncgtattactaccttaanaaggtcgggcacgctacggagtaccgcgtaggacggaccgtacggtacgtagttaacgttaacgttacggttgggtaggggtaaggacggggtaacgtaaccgggttaacggttaacggggtaacgttaaggggggttcggtttaacggggggccggtaaaccggggg

SEQ ID NO: 267362 - DNA, 814 bp, Homo sapiens
  misc_feature: GYAE6OF01D2GD0.28.57.F02.1.454.CMB.1.raw
  modified_base (721)..(721): a, c, t, g, unknown or other
  misc_feature (721)..(721): n is a, c, g, or t
  modified_base (799)..(799): a, c, t, g, unknown or other
  misc_feature (799)..(799): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagtcgttggttttccttgttgtactttaagttttaaaggtcgtccgtagtggtggaggtcgcgagtcgtgggtgggtacggttcggtaggggggtacgtccgtttacgggtcccgtacggtcccgggttcggggggtcccctaggaacggtaccttccgttccgtggtaccgaccgtcgtccctcggtcgttaccttacccgtaccttacgtaagtttatttacgtgtcctagtcggcccgtagggtccgggtccccgaccggtacggtccgtaccgggaacggggtacggtagttacggtaacgttagttcgttccgtaagttaagtagttaaagtaagtacgtaacggaactaaactacgtaattaggtttaattacgtacgtaactaaacgtgtacggtaaggaacggtctaacgtacgtaccaacgtacgtaccgtaacggaacgtaacctaacgtaacgaaccacgtaaccgtattactacgttacgtaagtacggtacgacgtacgacgtacgacggtaagtccggaacggtaccgtacggacgttagttacggtaacgttcggtaacggngggtaaccgggaggtaaccggggtacggtttaaggacgggttttaaggacggggggtttaggaccggggttaaccggnggggtaaaccccggg

SEQ ID NO: 267363 - DNA, 757 bp, Homo sapiens
  misc_feature: GYAE6OF01DEL3P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttaatttttaaaggtgtccagtgtgaggtgcagctgggtggagtcgtgggggagtcttggtccaggtccggtcggggggtccctggacgtacctcctccgtgtgccacggtcctcgtaggtacttcctaccttctaagtttatttatgtctatcgcgtacgtcgggtcccgccgacggtccgtaccggaaggggaacggtacgtagggtaattagtcgttacgtaacgtaaggttaagttaaggaaagttaagtacgaaccgtaaaattaaataagttaatttaattagtacgtaacctaaacgtttcgaggtaaggaacgggactaacgtacttacccgacctaaccgttccgaaccggtaaggtaacctaaacttaacccgaaagtaacccgtacgtactttacgtactttaccttaagaaacggttcgggactaccggtccgtaagggacgtacggtccgaaggaccggtacgtacggttaccttagttaaccgttagtacggtaggggtaacgggaaggtagggaacggtaaggttaaggttaacgggtaacggttgggggtacgggaccggggtaccgggtaacgggg

SEQ ID NO: 267364 - DNA, 643 bp, Homo sapiens
  misc_feature: GYAE6OF01A8QJF.28.57.F02.1.454.CMB.1.raw
  modified_base (523)..(523): a, c, t, g, unknown or other
  misc_feature (523)..(523): n is a, c, g, or t
  modified_base (554)..(554): a, c, t, g, unknown or other
  misc_feature (554)..(554): n is a, c, g, or t
  modified_base (634)..(634): a, c, t, g, unknown or other
  misc_feature (634)..(634): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagtcgttcggtccaggccggtcggggggtcccctggacgtaccttccgtccgtgtcgcgtacgtcctcgtggtacttcctacctttcgagttatttatgtcctagttcgccgtacgtcgggtcccgccgacggcccttaccggaaggggaacgggtactagggtaatagtcgtctacgtaaggttaacttaagaaacgtagacgacgtaaataactatattatagtacgaactaaactgtacggtaggaacggtactaacgtatcccaaccgtcgtccaacggacgaatactaccgaaagcctacgtntagtacttactaacgatcgggcaacgcgtanacgtgacgtgacggactcggtatagtagttatacggtggaggagacggacgagtaacgtcggaaggttagggtggacggnggtaacggg

SEQ ID NO: 267365 - DNA, 760 bp, Homo sapiens
  misc_feature: GYAE6OF01EGSQ6.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtgggggaggtcttggtccgaggcccggtcgggggggtcccctggacgtacctcctccgtgtgccacgtcctcgtggacttccacctttctagttatttatgtctatgacacgtcgggtcccncaggtcctaccggaaggggagggtaccgtagggtaattagtcgtactcgtaaggttaattaaggtaaattaagacggtaacgtaaaattaaactattaattaaattacgtagtaacctaaaacgttcgttaggtaacggggtaaacggctaacgttaacttaccgaccctaacgttaccctaacccgggtaaacgggtaacctaaaccgttaacccgaaaaccgtaacgtaaccgtacgttacgttaactttacccttaaacgtaagtccgggacttaaccggaccgtaggacgaacggttcggaggaccggtacgtacgtacgtagttaaaccgtagtttacggtagggttaggggaggtacgggtaaggaccggggttaaagtgggttaaacgttaggggggttacggtcgggggaccggtacggggg

SEQ ID NO: 267366 - DNA, 856 bp, Homo sapiens
  misc_feature: GYAE6OF01B8LZJ.28.57.F02.1.454.CMB.1.raw
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttcgtgtaggctatttaaagtgcagtgngaggtgcngctggtgagtcgtgggggagtcgttgccagtccgtgggggtcctagagactctcgtgtcgactcnctgtgactctactctattattagtgtntatagcgtacggtccggtccgaccgtacgtaccgtaccggaacgggaacggtacgtaaggtaagtacgtacgtacgtacgtaggttaagtaaggtaagtaagtacgtaacgtaaacgtaaacgtaaattaattaagttaacttaacgtaacgttaaaccgttacgttaacggtaacgggtaaacggtaccggtaacgttaacgtaaccgtaaccgtaaccgttaacccgtaaccggtaaaccggtaaaccgttaaacccgtaaaccgtaaaacccggtaaaccgtaaccgttaaccgttaacggtttaacgtttaacccgttaaacgtaaacggtaaccggtaacggtaaccggtaaccggtacgggtaacggtacggtacggtaacgggtaaccgggtaaccggtaaccggtaaccggtttaacgtttaaagtttaacggttaccgggttaggggttaaaggggtaacggggtaacgggtaaaccggggttaagggttaaacggggtttaaacggggttaacggggtttaacggggtttacgggggttaccgggggttaacccgggggtaaccggggg

SEQ ID NO: 267367 - DNA, 840 bp, Homo sapiens
  misc_feature: GYAE6OF01EACAG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttggggctgagcgttgggttttccttgttgcttaatttttaaaggtgtccagtgtgaggtgcagcgtggtggagttcggtgggggaggtcgttggtcccgtaggtcccggttcgggggggtcccctaggacgtacctccgttcccttggtcgccgacgtcccttcgtaggtaacttcctaaccctttacgtaagtttaattttacgtgtaccttaagttcgaccgtaccggttccgggggtccccacccggaacgggtcccgttacccggggaaagggggaaacggggtaccgtaaggggtaaattagttcggttacctaacggtaagggttaagtttaaaaggtaaagttaaagtacggtaaacgtaaaataaacttaagttaaatttaatttaagtcggtaaaccttaaaacgttcgttaaggtaaggaacggaacgtaagtaacttacccaaccgtactaccgtaaacccgtaacgggtaactaaacgtaaccgaaacggaaccgtacgtaccttagtaacttaccgttaaacgtaaacgttacgggacctaggtaccctagggaacgtcggtacggtacggaacggacgtacggtactttaaggttattaacggtttaacggtgggtaaggggaggaagggaacgtaagggtaacggttacgggtaaggttaagggttcgggacggggtcggtaaccgggg

SEQ ID NO: 267368 - DNA, 977 bp, Homo sapiens
  misc_feature: GYAE6OF01EBCYC.28.57.F02.1.454.CMB.1.raw
tcagagtacgctatcacgaccggtgctcgatttagctcgatatagttgggtctgggagaggagcccccgccctgggtttccccgaggttgttctctatttggtgatcagcacgtgcacacagaagagtcatgacgggtaggtttgggctggagtcgtttgggtttttccttgttgtctttaagtttttaaaggtgttcctagttggtggaggtgcagtcgtgggtggagtcggtgggggaggtcgttcggtcccacggtccggtcggggggtccctggtacgaccttcctccgtgtcgccgtagtcccctgtggtacttcctaaccgttctaaggtttactttagtcgtacttagtcgtaccgtacggtccggggtccccgaccggtacgggtcccgttaaccggggaaaggggggtaaacggggtaccgttaaggtaaacgtttaacgttcggttaccgtaacggttaaagggtttaaaagtttaaacgggtaaaaggttaaacgtacggtaaccgtaaaaaacttaacgtaaatttaaactttaatttaacgtacgtaaaccttaaaacgttccgttagggtaaagggaaacggggtacctaaaggttaccttaccccgaaacccgttaacgttacccgttaaccccgggaaaagggttaaaccttaaaaccgtttaaacccggaaaaacggtaacccgtaaccgggttaacgtttaacggttaaacctttaaccttaaacgtaaaacggggttcgggaactaacgggtaccggttaaggaacgggtacgtacccggttaagggaaccgggaaccgtacgggtaccttaagtttaaacgttacggtttacgggtaggggtaacggggaaagggtaacggggtaagggttaacggttaaaacggggtttcgggggtaaaacgggttttaggggggtttacgggggtaacccgggggaccgggggtaaacccggggg

SEQ ID NO: 267369 - DNA, 779 bp, Homo sapiens
  misc_feature: GYAE6OF01BZBN7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggtgtccagtgtgaggtgcagctggtggagtcgtgggggagcttggtccagccgtgggggtccctgagactctcctgtgcagcctcgtggtattccacctttcagttatttatgtctagttgcacgtcggggtcccgccaggcctaccggaaggggaacgggactggaatatgtctacgtaggtattaaggaagtatagacgtaaataaactattaataattagtcgaactaacgtcttaggtaaggaagggtactaaggtaactttcccaaccctagttaccccgtaacggaacgggtaaaccttaaaccgttaacccgaaaaggttaacccaacccggtacgtttacggttaccttaccgtttaaacgaacggttaccggggtacaaaccggttcccgttaaggaacggtacgtacccgggttaggaaacccgggtaacgtaaccggggtcttaacgggttaaagtttaacggtttacggtagggggttaacgggggaaagggtaacggggaacccgggttaagggttaaaaccgggtttacggggttaaaacgggtttttagggggtttagggtaacccggggggtaccgggtaaaaccgggggg

SEQ ID NO: 267370 - DNA, 736 bp, Homo sapiens
  misc_feature: GYAE6OF01C7D3H.28.57.F02.1.454.CMB.1.raw
  modified_base (258)..(258): a, c, t, g, unknown or other
  misc_feature (258)..(258): n is a, c, g, or t
  modified_base (559)..(559): a, c, t, g, unknown or other
  misc_feature (559)..(559): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttattttaaaggtgtcagtgtgaggtgcagcgtggtggagtcgtgggggagtcttggtccagccggtgggggtcctgagctctccgtgtgacngtcctcgtagtacttcctaaccttctaagttatttaagtgtactatcgactacggtcgggtcccgacgacgtctaccggaggggaaaggacgttaggaaatagttcgtactagtaaggttaattaagaaagttataacggtaacgtaaaacttaaagaattaattaaattaagtacgtaaccctaaaacttcgttaaggtaggaaacgggtactaaagtaccgttaaccaaccctagtacccgtaacgaacgggtaactaaacgtaaaccaaagaacccaggtacttagtaactacttaanaaacggttggaacctagaccgttaggaacgtagtacgacggtaacggaccgaccggtagtttaaccgtaatttaaacgttacggttacgggaaggggtaaggagggtaacggtacgggttaaagtacggggttaaaggtcgggggtttgggtaacccgggggtcggtaaaccggggg

SEQ ID NO: 267371 - DNA, 635 bp, Homo sapiens
  misc_feature: GYAE6OF01B3EP0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctcgtggacttccacctttcagttatttatgctatgcacgtcggggtcccgccgaggcctccgaagggggaacggggacgtaggaatagtcgtctcgtaaggttaattaaggaagttaatgacgaaataacattaatattatgacaaacttgtaggtacggaagggcaagtacttaccaaccctattcccgtacgaacgggtaactaacttaccgaaagaaccaaccgtctagttaactcctttaacgaaagtcgggacacggtcctaggaacgagtcgtaggacggacgacggtcgtagtattaagttacgtgggtagggagagggagtacggtagttacgggtaacggtaggggttggcgggggtacgtacgggg

SEQ ID NO: 267372 - DNA, 923 bp, Homo sapiens
  misc_feature: GYAE6OF01B8669.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcggtgggggagtcgtttgggtcccagccgttggggggtcccctggacgacctccgtccgtggtgcgacgtcctcgttggtactttcctacctttcgaagtttaattttaagtcggtacttaagtcgaccgtacggttccggggtcccgacccgtacgggtcccttaccgggaaagggggtaaacggggtacgttaagggtaaattacgttacggttacccgttaccggttaaagggttaacgttaaaggtaaaggttaaacgttggaaccgtaaaacttaaaacgtaatttaatttaaacgtttaagtacgtaaaccgtaaaacctttcggtaggttaacgggaaacgggtactaaagtacttaccccaaaccgttaaccgttaccccggttaacccggaaagggttaaaccctaaacgtttaacccgaaaacggtaccctaaccggttcgtttaacgtttaaccttaaccgtttaaacggaaagggttccgggaacctaacgggttaccgtaagggaaccgttacgggtaccgtaacgggaaacccggtcccgggtaaggtttccgttaaggtttaaaccgttaacggtttacgggtttaaggggaacggggtaaagggtaccggggtaaagggttaacccggttaaaggttttacggggaaaccggggtttttagggggttcccgggaacggggggtaacccgtacccgggggg

SEQ ID NO: 267373 - DNA, 542 bp, Homo sapiens
  misc_feature: GYAE6OF01EJDI6.28.57.F02.1.454.CMB.1.raw
  modified_base (331)..(331): a, c, t, g, unknown or other
  misc_feature (331)..(331): n is a, c, g, or t
  modified_base (462)..(462): a, c, t, g, unknown or other
  misc_feature (462)..(462): n is a, c, g, or t
  modified_base (495)..(495): a, c, t, g, unknown or other
  misc_feature (495)..(495): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctnaggtattagaagtaatgacgaataaacataataattaatgtacaaaactcgtgtagaagggcagaattcaccatctaccagggacaaattccaaagaacacgctgtatcttcaaatgggacagctgagtanctgagacacggctgtataattacgtgtagggangggaagcggaaattgggaaacttaggggttgtgggggacctaggggg

SEQ ID NO: 267374 - DNA, 724 bp, Homo sapiens
  misc_feature: GYAE6OF01B9585.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctgggtggagtcgtggggggaggcttggtccagccgtggggggtccctgagactctcctgtgcagcctcgtggattccaccttcagttatttatgctatgactacgtcgggtcccgccgacggcctacggaggggaacgggactaggaatagtgtctacgaggttaatagaagtatagacaataacatatattatagacaaacttctaggtaggaaggacagtactaccaacctatccgtaccgaagggtaactaaccgttaaccgaaagaacccacggtacttaacgtttaacttaccgttaacgtaaaggtcggggtaccacgtaccggttaacggaagggtaccgtcggtacggaaccggaccgggtaccggttacgttaggtttaaacttaacggtttaccggttagggggtaaggggaacgggtaaacggggtacgggttaaacggtaacggggttttaaccgggggaaacgggttttaagggggggttcggggttccggggggtaacccggttaaccggggggg

SEQ ID NO: 267375 - DNA, 866 bp, Homo sapiens
  misc_feature: GYAE6OF01EAY8A.28.57.F02.1.454.CMB.1.raw
  modified_base (330)..(330): a, c, t, g, unknown or other
  misc_feature (330)..(330): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtcttagtttttaaaggtgtccagtgtggaggtgcagtcgtggtggaggtcggtgggggaggtcgttggtccgaggtccggtcggggggtccctggacgtacttccgtccgtgtacgcacgtcccttcgtaggtacttaccgtacctttacgtagtttatttagngtactagtcgcctaggtccgggtcccgacgacggtccgtaccggaacggggaacgggtacgtaggtaattacgttcgttaccgttaggtaaggttttaaagttaaaggtaaacggttaagtacggtaaaccgtaaaagttaaactaagtttaaatttaagtttaaagtacgtaaaccttaaacgttcggttaaggtaaggaaacgggtacgtaacgttaacgttaccctaaccgttaccgttacccgtaaaccgggtaacggtaaaccgttaaacccttaaccggaaaacgaacccgttacgttaacggtttacgtttaaccgttacgtttaaacggaaggtcccggggactaaccggtcgtaaaggacggtaacggtacggtacgggaacggtaccgtacccggtagtttaggttaaaccgttagttacgggtggggaacgggtaagggtacgggtaacgggtaacggtttaagggttacggggtaaacgggttttacggggttaggggtacccggggggaacgtaacccggggg

SEQ ID NO: 267376 - DNA, 818 bp, Homo sapiens
  misc_feature: GYAE6OF01A784K.28.57.F02.1.454.CMB.1.raw
  modified_base (257)..(257): a, c, t, g, unknown or other
  misc_feature (257)..(257): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtggggagcttggtccagccgtgggggtccctgagactctcctgtcgacncgcctcgtggtattccgacctttcagttatttatgctatgcacgtggtcccgccgaggtcctacgaaggggaacggactcgggaaattgtcgtactacgtaggttataacgaagttagtcgaactaaactaactagttaacgtacttaagtacgtaactaaaccgttacggttaggtaagggtaacgggactaaacgtacgttacccgaaacccgttacgtcccggttaaacccggaacggggtaaacccttaaaaccggtttacccctaaaaggaaccccgttaaccggttaccgtttaacggtttaaacttaccccgtttaaaacggaaaagggtttcccggggtaacctaacccggggttaccttagggaaaaccgttccgggtaaccgttaacgggaaacgggtaccccggttaaggaccgtttagttaaccgtaaggtttttaccgggaggggttacggggtaaacgtaacgggggtacggtaaaccggttaagggttacccggttaaaagggggtttgggtaaccggggtttccgggggacgggttaaacccggg

SEQ ID NO: 267377 - DNA, 749 bp, Homo sapiens
  misc_feature: GYAE6OF01D376C.28.57.F02.1.454.CMB.1.raw
  modified_base (655)..(655): a, c, t, g, unknown or other
  misc_feature (655)..(655): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctggagtcgttgggtttttccttgttgtcttaagtttttaaaggtgtccagtgtgaggtgcagtcgtgggtggaggtcggtgggggaggtcgttcggtccgaggtcccggttcgggggggttcccctggacggtaccttccgtccgttggtcgccacgtccttcgtggtacttcctaccttcgtagttatttagtgtacttagtcgacgtacggtcgggtcccgcgacggtccgtacgggaaggggtacggtacgtaggtaacttacgttcggttcgtaacgtaaggtttaaagtaaggtaaacgttaagtaggaacctaaaagttaactaagttaattaagttacgtacgtaactaaacgttcgttagggaaggtaacggtactaagttaaccttccgaacctacgtaccgtaaccgaacggtaaactaacgtaaccgaacgaacctcgtgttacgttactactacgaagtcggactaggctaggacgtagtcgacggaacgtacgtacggtntaacgttagtacgttacggtggggtaggaaggtacggaaggttcggaaaggtttgggaacggggtttggggtccgggagggccggtaaccgggg

SEQ ID NO: 267378 - DNA, 569 bp, Homo sapiens
  misc_feature: GYAE6OF01ELZJ8.28.57.F02.1.454.CMB.1.raw
  modified_base (543)..(543): a, c, t, g, unknown or other
  misc_feature (543)..(543): n is a, c, g, or t
  modified_base (565)..(566): a, c, t, g, unknown or other
  misc_feature (565)..(566): n is a, c, g, or t
  modified_base (569)..(569): a, c, t, g, unknown or other
  misc_feature (569)..(569): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccaggacaattccaagacacgctgtatcttcaaatgggcagcctgagagctgaggacacggctgtatattacgtggtgggagaggagacggtaagttgggaacgttaggggttggtgggggccgaagggacgcccgtggtccaccgtctcctcgacgccctaccgaccgaacgggcccagtccggtcccttccccgtcggcccgtccctcgcctccgacggacgccaccgtccgagacgcacgacgccggccctgggcctcgccgtgggtacgaacggtaccttacgtaccagtacgccgttactcgtaggacggcgggcncgggacgaaggccgactagagnnggn

SEQ ID NO: 267379 - DNA, 681 bp, Homo sapiens
  misc_feature: GYAE6OF01CYG8F.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcgttggtccaggccgtggggggtccctggagactctcctgtgcagcctctggacttccaccttcagttatttatgctatgacctacgtcgggtccgccgacggcctaccggaagggggaacgggacgtagggtaattagttgttccgtacgtaggttaattaaggtaaagtaatggtaacgtaaattaaactaattaataatttaagtacgtaactaaacttcgtaggtaggtaacgggacaagtaacttccaacctattaccgtacccggaaggtaacctaaacttacccgaaagaccgtacgtcttagtacttaccgttaacaaaggtcgggacaggtccaggacgacgtcgtaggaaccgaccgacggtcttagtaacttgttacggtgggtaggggaggtagggacggtaggtaaggttacgggaacgggttaggggttcgggcggggtacgtaacggggg

SEQ ID NO: 267380 - DNA, 741 bp, Homo sapiens
  misc_feature: GYAE6OF01AN045.28.57.F02.1.454.CMB.1.raw
tcagagtacgctatcacgaccggtgctcgatttagctcgatatagttgggtctgggagaggagcccccgcccttgggtttcccaggtgttctcatttggtgatcagcactgcacacagaagagtcatgacggagtttgggctgagcttgggttttccttgttgcttatttttaaaggtgtccagtgtgaggtgcagctggtggagtcgtggggggaggtcgttggtccgagccggtggggggtccctggacgctctccgtgtgcacgcctcgtggattcctaccttcagttactttatcgtctagtgacacgtcgggtcccgccgacggtccgtccggaaagggggaacgggtaccgtaggggtaaacttagtcgttactacgtaaggttaaagttaaggtaaagtaagtacggtaactaaaattaaacgtaattaaatttaattttaaacgacgtaaaccgtaaaacttaccggtttaagggtaacggaaaacgggggactaacggtaacttaacccaaccgtaacgttaccgtaccgaaacgggtaacctaacttaacccgaaaagtaaaccgaccgtactacgttaactcgttaactaacggtgggtacacgaccgtaggacgtgacgtaggaacgacgtacggtacttagtacgttacgttaaggtggtaaggaagggacggtaggtaaggttaagtacggtaagggttaagggtcggggtagggaccggtacgggg

SEQ ID NO: 267381 - DNA, 707 bp, Homo sapiens
  misc_feature: GYAE6OF01CHUAM.28.57.F02.1.454.CMB.1.raw
  modified_base (573)..(573): a, c, t, g, unknown or other
  misc_feature (573)..(573): n is a, c, g, or t
  modified_base (625)..(625): a, c, t, g, unknown or other
  misc_feature (625)..(625): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtccagtgtgaggtgcagcgtggtggagtcgtgggggagtcgttggtccaggccggtcggggggtccctgacgacctctccgtgtgcacgtcctcgtggtacttccacctttacagttatttatgcttatcgctacgtcgggtacccgcgtacggacgtaccggaaggggaaggtaaccgtaggtaatagtcgttaccgtagtaggttaagttaaagaagttaagtgtaacgaaataaactattaattaattatactaactaacgttgtaggtaaggaaggccagttaacctaccaactactaccgtacggagtaaacctaactaaccgaaagtacctacgtacttagtacttacttaagaacggtcgggacacggtaccgtaggacgtagngtaacggacggtaccgacggtatttaaggtacgtttaagttcgggtaagggngggaaaggtaacgggtaacgggtacggttaagttaccggggtaaggttacggggtcgggtaaccggggcggtaaacccgggg

SEQ ID NO: 267382 - DNA, 787 bp, Homo sapiens
  misc_feature: GYAE6OF01BBT7X.28.57.F02.1.454.CMB.1.raw
tcagagtacgctatcacgaccggtgctcgatttagctcgatatagttggggtcgtgggagaggagcccccgccctgggtttcccaggtgttctcatttggtgatcagcactgcacacagaagagtcatgacggagtttgggctggagctgggttttccttgttgctattttaaaggtgtccagtgtgaggtgcagctggtggagtcgtgggggaggcgttgggtccagccgtcggggggtccctggacgtactctcctgtcgcacgcctcgtggtacttccacccttcagttatttatgtctagtgccacgtcgggtcccgccgacggaccttcccggaagggggaacggggtaccgtagggtaagttagtcgttaccgtacgtaacggttaagttaaggtaaaggttaatacggaacgtaaaacttaaaccaagttagttaaagtttaacgtagaacctaaacgttcgttaggacggtaacgggactaaggtactttaccaacccgtaactcccgtaacccgtaaaggggtaaccctaaacgtttacccgaaacggtaaaccctacggttaccgttacgttaaacgttaccgttaacgtaaacggtcggggtaacaaccgggttacccgtaggtaacggtaccgtacggttacgggaacgggtaacgtacccgggtcgttaggttaacgttaacgtttacggtgggtaaggggaacggtagggtacggacgggtaaacgttacggggtaaacgttaggggttacgggtcggggaccggtaacgggg

SEQ ID NO: 267383 - DNA, 1097 bp, Homo sapiens
  misc_feature: GYAE6OF01DYTNI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtacttaagtttttaaaggtgtccagtgtgaggtgcagcgtgggtggagtcggtggggggaggtcgttcgggtcccaggtcccggttcgggggggtcccctaggaacgtaccttccgttcccgttggtcgccgtacgtcccttcgtagggtactttccctaacccttttccgaaggtttaattttacgtcggtccttaagtcggtaccgtaaccggttccgggggttcccccgaccgtacggggtcccgttacccgggaaagggggggtaaacggggtaaccgttagggggaaacttttacgttcggttaccgttaacggttaacgggttaaaagtttaaagggaaaagtttaaacgttggaaaccgtaaaaacgttaaaactaatttaaagtttaattttaacgtacggtaaacccttaaacctttccgggttaagggttaaacgggaaaaccgggggtacgttaacggtaaaccgttttaaccccgtaaaccccgttaacggtttacccccgtaaacccccggggtaaaaagggggttaaacccctttaaaaaccggttttaaaccccgaaaaaccgggtaaaccccgttaaccgggttacccgttttaaacgggttaaccctttttaacccgttaaacggtaaaaacgggtttccggggtaaccttaaaccgggtcccgtaacgggtaaacgggtaacgttaccgggttaacgggtaaccggggtacccggtaacgggtttaaccgtttaacggtttaaacgtttaaacggtttaacccgggttaggggggttaaagggggaacgggttaaacgggggtaaaccgggtaacgggggtttaaaacgtttaacggggggtaaacccggggttttaaggggggtttacgggggggtaacccgggggtaaccccgggttaaacccgggggggg

SEQ ID NO: 267384 - DNA, 613 bp, Homo sapiens
  misc_feature: GYAE6OF01A2GNH.28.57.F02.1.454.CMB.1.raw
  modified_base (330)..(330): a, c, t, g, unknown or other
  misc_feature (330)..(330): n is a, c, g, or t
  modified_base (383)..(383): a, c, t, g, unknown or other
  misc_feature (383)..(383): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagtatttatgctatgcactgggtccgccgaggctccgagggaagggactgggaatntgtctcaaggtattagaagtaatgacgaaataacataatattatgacaaactntagtgaagggcaagacttacacatctccgagggaactaacttaccgaaacgaaccacgtctatactcttacaaatcgggacacgccgtaggaggagtccgtaggaacggacgaaccggtcttaggttaacttaagttaccgtgggtaaggggaggtagggaacgggtacggtaagttaacggggtaaacgttagggggttcgggttaccgggggtccggtaaacgggggg

SEQ ID NO: 267385 - DNA, 769 bp, Homo sapiens
  misc_feature: GYAE6OF01CT33O.28.57.F02.1.454.CMB.1.raw
  modified_base (176)..(176): a, c, t, g, unknown or other
  misc_feature (176)..(176): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggngtccagtgtgaggtgcagctgggtggagtcgtgggggagcgttggtccagccgtggggggtccctgagactctcctgtgcacgccttcgtggacttcctaccttcagtttatttatgtcttagtgcacgttcgggtcccgaccgaggccgtaccggaaggggaacgggtactagggtaaattagttcggtcgtacgaaggtttaagttaaggaagttaacgtacgaaccgtaaaattaaacgtaatttaattaaagtttacgacgttaaaccaaacgtttcgttaacggtaagggaaacgggtcctaaggttaacttaccccaaccgtaacgttccccgaaccggaaagggtaaccttaaacgtaaccgaaacgtaaccgccgttaattacgttaactttcccgttaaagaaggtacgggacctcggtaaccgttaggaacggtacgtacgtacgggaacgggtacctaggggtctttaaggttacgttaacggtttcgtagggggtagggtaaaggcgggtaaaccgggtaggttaaacggttacgggttaaacggtggggggttttggaaccgggggcccgtaaacggggg

SEQ ID NO: 267386 - DNA, 798 bp, Homo sapiens
  misc_feature: GYAE6OF01DNSUU.28.57.F02.1.454.CMB.1.raw
tcagagtacgctatcacgaccggtgctcgatttagctcgatatagttgggtctgggagaggacgccccccgcccgttgggtttccccaggttgttctctatttggtgatcagcactgcacacagaagagtcatggacggtagtttgggctgacgtcgttggtttccttgttagtcttaagtttaaaggtcgtccgtagtgtgaggtcgcgagtcgtggtggtagtcggtgggggagttcgttcggtaccgcggtcccgggttcgggggtccctaggtacgtccttccgttccgtgtaccgaccgtacgtccgttcgtaggtacctttaccctacgtttacgtaacgtttatttagtcgtaccgtagttcgaccgtcggttccccgggacccgaccggacggtcccgtaaccgggaaggggaacgtaggtaagttactagttcgtacgtacgtaagttaagttaagtaaagtacgtaacgtaaagtaaacgttaataagttaatttaacgtacgtaacgtaacgttaacgtggtaacggtaacggaacggtatacggtactaccgactaccgtaccgaacgtaacggtaaaccttaacgaaaccgtaaacgtaccgtacgttaccttaagtttacgtaccttaacggaaagttccggaacaccggttacgacgggtataacggaccgtagggactaccgtacgttaacgtagtagttacggtacggtagggagggtaaggcggaggttaacgttaaggttacggtacgggtttaggcggggttacggacgggtaccggg

SEQ ID NO: 267387 - DNA, 546 bp, Homo sapiens
  misc_feature: GYAE6OF01ETQSQ.28.57.F02.1.454.CMB.1.raw
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (366)..(367): a, c, t, g, unknown or other
  misc_feature (366)..(367): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagccccccgcccctgggtttcccaggtgttctcatttggtgatcagcactgcacacagaagagtcatgacggagtttgggctgagctgggtttttccttgttgcttaatttttaaaggtgtccagtgtgaggtgcagctggtggagtcgtgggggagcgttggtccagccgtggggggtccctgacgactcctcctgtgcagcctctggattcaccttcagttatttatgctatgcacgtggtccgcaggctacgagggaggctagaatntgtctagagtatagaatanganaatanatatatannacaatngagagnagnttcacatctcgaggacataccaagaacacgctagtatcttacaagtggacacgcctaggagacgcgtaggacggacgacggtcgtagtatagttacgtaggtagggaggtagggaggtacgggtaaagttagggaacggttagggggttgggtcggggtaccgg

SEQ ID NO: 267388 - DNA, 759 bp, Homo sapiens
  misc_feature: GYAE6OF01B58YQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttgggttttccttgttgtcttaagttttaaaggtgtcctagtggtgagggtgcgaggtcgtgggtgggtaggtcggtggggggaggtcgttcgggtccgacggtccggtcggggggtcccctaggacggtccttccttccgtggtcgccacgtcctcgtggtacttcctaaccctttgtagttatttagtgtacttagtgccgtacgtcgggtcccgccgtacggccgtaccgaaggggaacggtacgtaggaatgtacgtctacgtagtaattaagaagtagtagaacgaaataactagttatagttaatacgaactaaacttccggtaaggtaggtaaacggacgttaagtaccttacccgactacgtacccgtacggtaaacgggtaacttaaaccttaaccgaaacgaaacgtacccgtaactttacgtacttaccttaagtaaagtccgggactaggtaaccctaggaacgagtacggtacggaacgaccgtacggtacgttaggtaacgttacgttaacggtgggttaaggggaaggtaagggtaacggtacggtaaagttcgggtaacggttaggggggtttcggacggggaccggtacgggg

SEQ ID NO: 267389 - DNA, 913 bp, Homo sapiens
  misc_feature: GYAE6OF01A6WIV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtcagtgtgaggtgcagcgtggtggagtcgtgggggagtcttggtccaggccgtcggggggtccctgagactcctcctgtgcacgtcctcgtggtacttcctaccctttcgaagttattttatgtcttatcgccgtacgtcggggtccccgaccgacgggtccgtaccggaagggggaaacgggtacgtagggaaatttagttcggttccgttacggtaaggttaattaaaggtaagttaagtacggaaacgtaaaactaaacgtaattaaatttaagtttaactacgaactaaaacgttcgttaggttaagggaaacggaccgtaaggttactttaccctaaccgtaacgttaccccgttaacccgggaaaaggtaaacctaaacccgtttaaaccgaaaaccggtaaacccgtaacccggttaccctttaacggtttaaccctttaaccccggtttaaaacggttaaaaccggggttaccggggtacccgtaaaccggttaccccgtaaggggtaaacgggtaaccggtaccgtaacggggtaaccggaaacccgggtaccgttaccggtttaaagttaacgtttaaacggtttaaccgggttaggggttacggggggaaacggggtaaaggggtacgggtaaaccggggtttaaaagggtttaacggggttaaaccgggtttaagggggggtttaccggggtaccgggggggtaaacccggtaacccgggggg

SEQ ID NO: 267390 - DNA, 565 bp, Homo sapiens
  misc_feature: GYAE6OF01EM15K.28.57.F02.1.454.CMB.1.raw
  modified_base (297)..(297): a, c, t, g, unknown or other
  misc_feature (297)..(297): n is a, c, g, or t
  modified_base (364)..(364): a, c, t, g, unknown or other
  misc_feature (364)..(364): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccncaggctccgagggaaggctggatatgtctcgaggtattagaagtaatgacgaataacataatattangacaaactcgtagtagaagggcagtacttaccgaaccatcctaccgagggaacaacgtttaccaaagaaccacgtcgtagtactcttacaaagtgggacacgcctgagagtctagacggacacggtctagtattagttacgtggttgggagagggtagtaggtaagttggaacggttagggtggttggggccgtaacgggg

SEQ ID NO: 267391 - DNA, 796 bp, Homo sapiens
  misc_feature: GYAE6OF01ES5AO.28.57.F02.1.454.CMB.1.raw
  modified_base (506)..(506): a, c, t, g, unknown or other
  misc_feature (506)..(506): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctagagcttgggttttccttgttgtcttaatttttaaaggtgtccagtgtgaggtgcagcgtgggtggtagtcggtgggggaggtcgttcggtccgacggtccgggtcgggggggttccccttggacggtacctccgttccgtgtcgcgacgtccttcgttggtacttccgtaccttcgtaagttatttagtgtacttagtcgaccgtaccggttcgggtaccccgccgtacgggtcccgtaccgggaagggggaacggtaccggttaagggaattacgttcgtacctaggtaaggttaagttaacgtaaagtaacgtacggaaactaaaacgtaacttaattacgttaatacgtcaactaaccgtntaggtaagacggtacacgttactacctaccgtacgtacgtacgggacgtaaacctacgttaaccaagaccgtacgtacttaacgttactacgttaaacgtaaacgggtcgacgtacggtacgtaaggaagaccgtacgtaaggaacgtaccggtaaccggtagttaacgtttaacgtaaacgtttcgggtaaggaaggggtacggtaaacggggtacgttaaccgggttaagggttaaacgggtaacgggttcgggggttacgggtaaccggggtcgggtaaacccgggg

SEQ ID NO: 267392 - DNA, 777 bp, Homo sapiens
  misc_feature: GYAE6OF01DGVCV.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagtcttgggttttccttgttgtcttaagtttttaaaggtgtccagtggtggaggtgcgagcgtgggtggtaggtcggtgggggaggtcgttgggtccgaggccgggttcggggggtcccctggacgtaccttccgtccgtggtcgcgacgtcctcgtaggtacttacctacctttacgtagtttatttagttcgtacttagtcgccgtacggttcggggtccccgccgtacggtcccgttaccgggaaggggtaacgggacgtaggtaattagtcgttacgtacgtaggttaagttaaggaaagttagtacgaaacgtaaataactaattattaattacgtacgtaacctaattcgtaggtaggaacgggtactagtaccttcgaaccttcgtaccgtacggaaggtaacctaactaccgaaacaacgtacgtcgttaagttaccttacttaacgaaggttcgggtacctaacggtaccgtggaacggtaccgtacgtagggaacggtaccggacggttagttaagttaacgttaagtacggttaggggagggtaaggtaagggtacggttaaagggtacggtttagggtaaaccgggttagggggttccgggtaggggacccgggttacgggg

SEQ ID NO: 267393 - DNA, 599 bp, Homo sapiens
  misc_feature: GYAE6OF01A2Q4P.28.57.F02.1.454.CMB.1.raw
  modified_base (302)..(302): a, c, t, g, unknown or other
  misc_feature (302)..(302): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctgtggtattcaccttcagtatttatgctatgtcacgtgggtccnccgaggctccgagggtaacggactacggaatatgtctctaggtattagaatatgacgtaaatactatatattangactaaacgtntagtaggaacggctaagtacttaccgacctactaccgtaccgaagggtactaacgttaccaaagacctacgtacttgtaactaccgttacaaaggttcggactaacgtcccgtaggacgacgtacgtacggtaacggacgtacggtcttagtacttacgtagtggtaggaggagaggagaagttaggaacgtgggttaggcgggcgtacggg

SEQ ID NO: 267394 - DNA, 862 bp, Homo sapiens
  misc_feature: GYAE6OF01CDHN9.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagtcgttgggttttccttgttgtcttagtttttaaaggtgtcctagtggtgaggtgcagtcgtgggtggtaggtcggtggggggagtcgttgggtccgacggtccggtgggggggtcccctggacgtaccttcctccgttgtcgcctacgtcccttcgtggtacttcctaccttcgtaagttaattttatggtacttagtcgtccgtacggttcggggtcccgtccgacgggtcccgttaccggaagggggtaaacgggaccgtagggaatagttcgtcgtacggtaaggttaagttaaggtaaagttaagtacggaacgtaaaattaaaactaagttaaatttaatttaacgtacgtaactaaaacgtttcgtaagggttaggaagggacgtaagtaccttaccaaccctacgtacccgtaacccggaagggtaaaccttaaaccgtaacccgaaaaggtaacccctaacggtcctttaacgtacgttaccttaaacgaaagggttccgggacttaacggacccgtaggaaacgggtacgtaccggtaaggaaccgggtaaccgtaacccggggttacttaagttaccgttaaacgtttacgggtaggggttaagggggaacgggtaaaggggtacggaaacggggttaaaggtttaacggggtaaaggggtttaggggggttcggggtaccggggggtccgggtaaacccgggggg

SEQ ID NO: 267395 - DNA, 902 bp, Homo sapiens
  misc_feature: GYAE6OF01DVLZY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagcgtggtggagtcgtgggggaggcgttggtccaggccgtggggggtccctggacgtactcctccgtgtcgcacggtcctcgtggtactttcctaccctttcgtaaggttaattttacgtcggtaccttaagtcggtaccgtaaccggttcgggggttacccccggacccggtaacggggtccccgttaccccggaaagggggggtaaacggggtaacccgttaggggtaaaacttaacggtttcggttaccgttaccggtaagggttttaaacgttaaacgggttaaaacggttaaagttacgggtaaaccggtaaaagttaaaaccctaaagtttaaaactttaaagttttaaacggttacgtaaacccgtaaaaaccgttccggttaaggttaacgggaaacgggtacgtaaaggtacctttaaccccgaacctacgttacccgtaacccggaaagggtaacctaaacgttacccgaaaagtacccgtacgtaccgttaagtaacttaccgttaacgaaaacgttcgggactaccggtaccgttaggaacggtagtccgtaagggaaccggtaccggacggttacgtagtttaaacgtagttaccgggttagggttaggggaaacggtacggggacggtaacgggttaaaggttaacgggaacggtttaggggggtcgggttaccgggggacgttaaccgggggg

SEQ ID NO: 267396 - DNA, 680 bp, Homo sapiens
  misc_feature: GYAE6OF01EB5F7.28.57.F02.1.454.CMB.1.raw
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
  modified_base (415)..(415): a, c, t, g, unknown or other
  misc_feature (415)..(415): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtgggtggagtcgtgggggaggtcttggtccaggtcccgtggggggtccctgacgtactcctcctgtgcagcctcgtggtattcaccttntagtatttatgctatgcacgtcggtcccgccaggcctaccggaaggggaacggactaggtaatagtgtctagtaggttatagaatatgacgtaaataanatatattatgacaactctaggtaggaaggntacgacttacacctattcctaccggaaggaacctaacttaacccaaagtaaccgaccgtcttagttaacttccttaacgaaaggttcgggaccgtaagtacccgtaggaacggtacgtacgtagggaacggaccgtagggtacctggttaaacgtttaacgttacggtggggttaagggacgggtaggggtaaccgggaggttaaagggttttaacgggaacgggtttaggggtacggggttacgggggcccggttaaacggggg

SEQ ID NO: 267397 - DNA, 789 bp, Homo sapiens
  misc_feature: GYAE6OF01BQZWL.28.57.F02.1.454.CMB.1.raw
  modified_base (676)..(676): a, c, t, g, unknown or other
  misc_feature (676)..(676): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtctggttttccttgttgcttaatttttaaggtgtccagtgtgaggtgcgagcgtggtggagtcgtgggggacgtcgttcggtccaggtcccggttcggggggtaccccttggacgtaccgttccgttcccgtggttcgccgacgtcccttcgtggtaccttacctacccgttacgtaagtttaacttttagtcgtacttacgtacgtccgtaccggttccggggtaccccgaccgtacgggtcccgttaccgggaaacggggtaaacgggtacttaacggggtaaatttaggtacgtttaccttacggttaaaggtttaattaaggtaaagttaaaggtcgtaaacgtaaaagttaaaaccgtaatttaattaagtttaatacgtaacctaaacgtcgttaggtaaggaacggtacgagttactaccctaaccgtactaccgacggtaaacggtaactaacgttaaccgaaagacctaacggtcttagtaccttaaccgttaacgagtcggacgtacgtacgtaggacacgngtaagggtaccacggtacgtcgtaagttatacggttacggtggtaagggaggtagacgggttaaggtaagttacgggtacggttaaggggttcgggacgggtcggtaacgggg

SEQ ID NO: 267398 - DNA, 752 bp, Homo sapiens
  misc_feature: GYAE6OF01CVRDR.28.57.F02.1.454.CMB.1.raw
  modified_base (432)..(432): a, c, t, g, unknown or other
  misc_feature (432)..(432): n is a, c, g, or t
  modified_base (635)..(635): a, c, t, g, unknown or other
  misc_feature (635)..(635): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgtcttatttttaaaggtgtccagtgtgaggtgcagcgtgggtggagtcgtgggggagcgttcggtccagtccggtcggggggtccctgagtacctctccgtgtgcgacgtcctcgtaggtacttcctaccttacgtagtttaatttagtgacttagtcgtaccgtaccggtccggggtcccgaccggacggtccgtacccggaaggggaaacgggtacgtaggtaaattagtcggttactacgtaaggtaagttaaggaaacgttaagngtaacgtaaattaaacattaattaattagacaactaactcgtaggtaggaaggactagtaacttccaacctgttcccgtaacggaaggtaaccttaaactaaccgaaactaaccgcgtactttagtactttaccgtaacgaaggttccgggactaacggtcgtaaggacgtacgtacggtagggaaccgtacggaaccggttntacgttaacgttacgttggtagggggtagggtaaggaaacggggtacggtaacgggttaggttaaacccggggttaaggttacgggggttaggggtccggggaccggtaaccggggg

SEQ ID NO: 267399 - DNA, 754 bp, Homo sapiens
  misc_feature: GYAE6OF01AFYO9.28.57.F02.1.454.CMB.1.raw
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagcggtcgttcgtcgtaggcgtacttaaagtgtcagtgtgagtgcagcgtggtgacgtgtggggacggcttggccgagtcgtgggggtcctgagactcctccgtgtgcacgtcctgttggacttcaccttacggagttatttagtntntacgcgcgtaccggtcggacccgtcggacgccggaccggaagggtacggtagtagtatcgtcgtactagtagttagttaagtaacgtagacgtaagtaaactaataattataacgttagtacgtaaccgtaagttcgtaggtaacggacggtactacggtaccttaccaccctacgtaccggtaccgtaacggtaaactaaccgtaaccgtaaacgtaaccgtaccgttacttaccgttaacttaccgtaacggtacggtaccgtaccgtaacgacggtaggacgtacggtacggtaggaacggtaccggttaaggtcgtttaaacggttagttaacggtttacggggtaggggtaagggtaacgggtaacgggtaaccgggttaaagggttaacgggttaaccgggggttaacggggttacgggggttacccggggtaccggggtaaccggggtacccgggg

SEQ ID NO: 267400 - DNA, 673 bp, Homo sapiens
  misc_feature: GYAE6OF01DN7ET.28.57.F02.1.454.CMB.1.raw
  modified_base (263)..(263): a, c, t, g, unknown or other
  misc_feature (263)..(263): n is a, c, g, or t
  modified_base (310)..(310): a, c, t, g, unknown or other
  misc_feature (310)..(310): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccagccgtggggggtccctgagactctcctgtgcagcctcnggtattccaccttcagttatttatgcttagtcgcacgtcgggtcccncgaggctccgaggggaaggacgtaggaacttagtgtctacgtaggttaattagaagtaatgacgaaataactattatattatgacctaaattctaggtagagggacacgtattacccactatccaccggaaggtaactaacgtaccaagaacctaggtccctagtattacctttagaaacgttcggggaccacggtacctagggacgtacggtctaacgggaacggtcccaaggggtttacctaggtttaattaaacggttcgtaaaggggtggggtaaaccggtaaggacggggttacgtaaaagggttacggttaaacgggtttgggggttaacggggtcggggtaacccgggtaacgggg

SEQ ID NO: 267401 - DNA, 650 bp, Homo sapiens
  misc_feature: GYAE6OF01ELAID.28.57.F02.1.454.CMB.1.raw
  modified_base (310)..(310): a, c, t, g, unknown or other
  misc_feature (310)..(310): n is a, c, g, or t
  modified_base (584)..(584): a, c, t, g, unknown or other
  misc_feature (584)..(584): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggaggcttggtccaggccgtggggggtcccctggacgactctcctgtgcagcctcgtggattcacctttcagttatttatgctatgcacgtcgggtccnccgaggctccgaggggaagggactaggaatatcgtctcgagttaagttagaaagtatggacgaaataactaataattattaatacgactaaactctaggtaggaaaggtacaagtacttaccaaccactcctaccgaagggaacctaaactttacccgaaagaacaccgtactgttacttacgttaccaaagttcgggacaggtacctaggagtagcgtaggtacgggaccgacgggtcttaggttaattacgttacgtgggtaggggtaaggnggggtaacgggtaggtaacggtttaggggaacgtttagggggtgggtcggggaccgggtaacgggg

SEQ ID NO: 267402 - DNA, 765 bp, Homo sapiens
  misc_feature: GYAE6OF01CYEV7.28.57.F02.1.454.CMB.1.raw
  modified_base (174)..(174): a, c, t, g, unknown or other
  misc_feature (174)..(174): n is a, c, g, or t
  modified_base (188)..(188): a, c, t, g, unknown or other
  misc_feature (188)..(188): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtctgggttttcctgttgtctattttaaggntccagtgtgaggtncgagctggtggagtcgtgggggagcttggtccaggtccgtggggggtccctggacgtacctctccgtggtacgcacgtcctcgtggtacttaccgtaccttacgtagttaactttacgtcgtactacgtcgcgtacggtcggtccgacgtacggtcgtacggacgggtacggtacgtacggtaacgtacgtcggtacgtacgtaggttaacgtaacggtaacgtaacgtacgtaacgtaaacgtaacgtagttaacgttacgttacgtacgtaactaaacgttcgtaggtacggacgggtactacgtacgtaccgtaccgtacgttaccgtaccgtaacggtaactaaccgttaaccgtaacggtaaccgtaccggttacgttacgttaccgttacgttaacgtaacggtccggtacgtacggtaccgtacggtacggtaccgtacgtacggtaacggtacggtacggtacgttaacgtacgttaacggttacggtacggtacgggtaacggtacggtaacggtacggttaaggttaccgggtacggttacgggttcgggtaccgggtacggtacgg

SEQ ID NO: 267403 - DNA, 777 bp, Homo sapiens
  misc_feature: GYAE6OF01D2R54.28.57.F02.1.454.CMB.1.raw
  modified_base (269)..(269): a, c, t, g, unknown or other
  misc_feature (269)..(269): n is a, c, g, or t
tcagagtacgctatcacgaccggtgctcgatttagctcgatatagttgggtcgtgggagaggagcccccgaccctgggttttcccgaggtgttcgtcatttgggtggactcgagcacctggcaacacagaacgagtcatgacggagtttgggcgtgagctgggttttccttgttgctatttttaaaggtgtccagtgtgaggtgcagctggtggagtcgtgggggaggcttggtccagccgtggggggtccctgagactctcctgtgcngcctctggattccaccttcagttatttatgctatgcacgtcgggtcccgccaggcctaccggtaggggaagggtaccgtagggaactagttcggtacttacgaaggttattaaggaaagttaatcggaacgtaaataaacgaattaattaatttaagtcgtaactaaaccttcgttaggttacggaaacggggcctaaggtaactttacccgaacctacgtacccgtttaccccggaaaaggggtaaccttaaaacgttaacccgaaacggtaaaccctacggtaccctttaggttaaacttacccgttttaacgaaaacggtttcggggacgtaaccgtcccgtagggaacgtacggtacgtacgggtacggaccgtaaccgggtcttaaggtactttaacgtacggttaggggttaggggaacggtaacgggacggtaacgggttaacgttagggggtaaaaccggtttgggggtttcggggcgggggtaccgtaaaccggggggg

SEQ ID NO: 267404 - DNA, 816 bp, Homo sapiens
  misc_feature: GYAE6OF01COI1E.28.57.F02.1.454.CMB.1.raw
  modified_base (756)..(756): a, c, t, g, unknown or other
  misc_feature (756)..(756): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtctttaagtttttaaaggtcgtccagtgtgaggtgcagcgtgggtggagtcggtgggggaggtccgttggtccgacggtcccgggttcggggggttcccctggacgtacctcctccgtgtcgccacgtccttcgtggtacttcctacctttctagttactttagtcgtcttagtcgtaccgtacggttccgggtccccgaccggtacgggtcccttaccgggaaagggggtaaacggggtaccgttaaggggtaaatttacggttcggtttacccgttaggtaaacggtttaagttaaaaggtaaaaggttaaacgttcggaaaccgtaaaattaaaccgtaattaatttaactttaagtaacgtaacctaaaacgtttcgtaaggttaggaaacgggtactaacgggtaactttacccgaacccgttacttaccgtaacccgggtaaacggtaaccctaacgttaacccgaaaccgtaacgtacccggtacttacgttaaccttactttaaacggaacgtcgggtacctaacgtaccggtaggaacgtacgacgtacgggtacgacgacgttactagtattaggttacgngggttaggaaggtacgaggtacgttagtacgggtagttagggtggcggtacggtacgggg

SEQ ID NO: 267405 - DNA, 675 bp, Homo sapiens
  misc_feature: GYAE6OF01E00CD.28.57.F02.1.454.CMB.1.raw
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctccgtgtgcagcctctggattcaccttcagtatttatgctatgcacgtggtccgcaggctcgagggaggctaggatagtgtctcgaggtattaggaagtatgacgtaatactatatattatcgaacaaacctntgtaggaaggcaagtactacaccatctacccgaagggtacctaacgttaccaaaggaaccacggtacttacgtaacttaccgtttaacaaacggttcggggaccaacggtccgtaggaaggtacggtaccgttacgggaacggtacccgaacgggtaccgttaaggtttaaataacggttttacggttagggtaagggggtaagggtaacggggaacggtacgggtaaaggttttaacggggtaaaccgggtttaaggggggtttacgggtcgggggggtaacccgtaacgggggg

SEQ ID NO: 267406 - DNA, 829 bp, Homo sapiens
  misc_feature: GYAE6OF01DA9WV.28.57.F02.1.454.CMB.1.raw
tcagagtacgctatcacgaccggtgctcgatttagctcgatatagttgggtctgggagaggacgcccccgcccttgggtttcccaggtgttctcatttggtgatcagcactgcacacagaagagtcatggacggtagtttgggctgagtcgttgggttttccttggttgtcgtttaagtttttaaagggtcgtcctaggtggttaggagggttcgcgtaaggtcggttggggttagggtaggttcggtgggggggaaggttccgtttcggggtccccgagggtcccggggttcgggggggtccccttaggacgtaccttccgtccgtggtcgccacgtccttcgtaggttaccttcctaccctttcgtaagtttacttttagtcgtactttacgtcgacgtaccggtccggggtcccaccggtacgggtaccgtacccgggaaaggggtaacgggtaccgttaggtaaagttacgtacgttttactaacgggtaaggttaaagttaaagggtaaagttaagtaacgtaacggtaaaaactaaacgttagtttaaatttattacggaactaaccgtaaacgttcgtaggtaaggtaacgggtacttaacgtctaacccaacctacgttaccgaaccggtacggtaacttaacgtaaccgtaaagacctacggtcttagaactttactaagacggtacgacgtcgaacgtggaacgcgttacgacggacgtacgaccggttactagttacggtattacgggtaggtagggtaaggtggtacgtaaggttaacggtggttacggtaggggttacgggccggttagggaccgg

SEQ ID NO: 267407 - DNA, 720 bp, Homo sapiens
  misc_feature: GYAE6OF01BL42G.28.57.F02.1.454.CMB.1.raw
  modified_base (262)..(262): a, c, t, g, unknown or other
  misc_feature (262)..(262): n is a, c, g, or t
  modified_base (337)..(337): a, c, t, g, unknown or other
  misc_feature (337)..(337): n is a, c, g, or t
  modified_base (560)..(560): a, c, t, g, unknown or other
  misc_feature (560)..(560): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagtgtgaggtgtagctgggtggagtcgtgggggagtcttggtccaggccgtggggggtccctgacgactctcctgtgacnggcctcgtggtattcctaacctttcgtaaggtttatttagtacggacttaagtcgactaccggttcggggtcccnccgacggtccttacccggaagggggtaacggacgttagggaattagttcggtctacgaaggttataaggtaagttaagtcggaagtaaataacgattaatagttactagaactaaacgtttcgtagggttaacggaaagggacaacggttctaacccgtaacctaagtttcccacccggtaaagggtaaaccctaaacgttacccgaaaacggactaaccggngttactacgtacttaacgaaggttcgactcgtccaggtacgacgcgtaacggagacgacggtcttaagtcgttaattcggagggtgggaaggtaggacggtaccgtaggttaacgggtaaccggttaggggttacggcggggtacggacggggtaacccg

SEQ ID NO: 267408 - DNA, 915 bp, Homo sapiens
  misc_feature: GYAE6OF01AMPV2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcttcggtccagccggtggggggtccctgagtactctccgtgtgcgacgcctcgtggtacttccgacctttcgtaagttatttatgtacctatgactaccggtcgggtcccgaccgtagggtaccctaccggaagggggaacgggtacgttaggggaaattacgttcggttaccttaccggtaaagggtttaaagtttaaacggaaaaggtttaacgtacggtaaacccggtaaaaattaaaacttaagtttaaatttaagtttaaaccgttacgtaaacctaaaaaccgttcgttaggggtaaacggaaacgggtaaccgtaagttaacctttacccaaccgtaacctaccccggtaaccgaaacgggtaacctaaacgttaaacccgaaaacgacccgtaaccgttcgttacgtttaaccgttacttaaccggtaacggttaccgggaacgtaccggtaccgtagggtaaaccgtacggtacggtaacgggaaccggtaaccgggttaacggtcccggtttaaagtttaaacgttttaaacgggttaaccgggtttggggggtaaaggggtaaacggggttaacggggtaaaccggttaaacgggggttttaaacgggtttaaaacgggggttaaacgggtttttaaggggggtaccggggggttaaccggggggaaccccggggttaaaccggggggg

SEQ ID NO: 267409 - DNA, 828 bp, Homo sapiens
  misc_feature: GYAE6OF01BN1P7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagtcgttgggtttttccttgttgtcttaagtttttaaaggtgtccagtggtgaggtgcgagcgtgggtggaggttcggtggggggtaggtccgtttcggtcccgacggtcccgggttcgggggggttcccctggacgtaccttccgttcccgttggtcgccgtacgccccgttacgttcggtaactttccctacccttttcgtaaggtttaattttagtcgtcttagtcgaccgtcggtcggggtcccgccgtagggcccgtaccggaaggggaacgggtacgtagggtaatagttcgtcgtacgtaaggttaagtaagtaaaggttaagtagaacgtaaactaacgtaattaacttagttatacgaactaaacgttcgtaggtacgggaaggtcgaagtactacccacctataccgtaccgaaacggtaactaacgttaaccgaaaccgtaaccgtaccgtacttaagttaccttacgttaaacgaacggttcgggacgtccgtaaccggtagaagggtacggtcggttaacgggaggaacccgtacgggttagttacggttaaagttacgttaccgggttaggggtagggtaacgggtgggaaacgggttaagttaaacgggttaacggggttaacggggttagggggtttacggggacgggggtacccgggtaacccggggg

SEQ ID NO: 267410 - DNA, 778 bp, Homo sapiens
  misc_feature: GYAE6OF01CLCJD.28.57.F02.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
tcagagtacgctatcacgaccggtgctcgatttagctcgatatagttgggtctgggagaggacgcccccgccctgggtttcccaggtgttctctagtttggtgatcagcactgcacacagagagtcagtcggacggtgttgggctaggacggtcgttggtttcctggttacgtacgtttaagttttaaggcgtcgtaggtcgtggngtgcgaggtcgtgggtggnggtcgggtagggggtntcggttcggccgacggtccgggtcggggtcctaggacgccgttcgtcgtgcgcgacgtccgtcggtattctccgttactntagtttaatcgtntacgttagacggtcgtaccggacgggtccccagggtcgtaacccggaggtaacggggactaggtaggtatacgtacgggtacctaaggtaacggttaagtaagtaaggtactaacgaaataaattagtatatacgttanacgtacttaaacgngtaaggaggtaacgactcgtaaccgtacgacctaggttaccaacggttaaacgtaaacctaacgttaaccgaaataccgggtacttaacggttaactacgttacgtaacggtaacgtacggtaacgtcggtaacggtcgtaaacgggccgaacttacggagtaacccggtgttaaccgtttgaaacgttggttaaacggtggggtaacggaaccgggtggtttaacgggaagggtttaccgggtaaggttaaacggggtcggggtaacggtaccggggtaacggcccgggg

SEQ ID NO: 267411 - DNA, 616 bp, Homo sapiens
  misc_feature: GYAE6OF01A06A3.28.57.F02.1.454.CMB.1.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (477)..(477): a, c, t, g, unknown or other
  misc_feature (477)..(477): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtgctatttaaggtgtccagtgtgaggtgcagctggtggagtcgtgggggagcttggtccagccgtgggggtccctgagactctcctgtgcagcctcgnggtattccacctttnagttatttagngtctagtcgctacgtgggtcccgcacggtcctaccggaaggggaaacgggactagggaattatggtcctaggaaggttaattaaggaaagttaagtcgaacgtaaaataacattaatattagtcgaactaaactgtagtaggaaggtcaagtacttacacctatccgacgaggaacctaattaccgaaagtacacgtntagtactactacaagtcggactagccgtagagacgtcgtaggtaacgacgcgacgtagttaatacgtaagtcgggtagggacgagggacgtacggtaagttacggacggttaaggggtgggacgggtccggtaacgggg

SEQ ID NO: 267412 - DNA, 621 bp, Homo sapiens
  misc_feature: GYAE6OF01EU90L.28.57.F02.1.454.CMB.1.raw
  modified_base (378)..(378): a, c, t, g, unknown or other
  misc_feature (378)..(378): n is a, c, g, or t
  modified_base (553)..(553): a, c, t, g, unknown or other
  misc_feature (553)..(553): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtggggggtccctgagactctcctgtgcagcctcgtggattccaccttcagttatttatgctatgcacgtcgggtcccgcgaggcctccggaggggagggactagggaatatgtctcgaggttaatagaagtatgacgtaataacatatattanacgactaaactctaggtaggaaggtcaaggtactaccgacctagttcccgaccgagggaactaacgttaccaaaacgaaccacgtactagttacttaccttaacgaaagttcgggacctacgaccgtaggagtacgcgtaggaccgacgacgggtatacggttattagttacggnggtagggaaggtagggacggtaggtaaggttaccgggtaaggttaggggtcgtggggccgtacggggg

SEQ ID NO: 267413 - DNA, 742 bp, Homo sapiens
  misc_feature: GYAE6OF01A9SEI.28.57.F02.1.454.CMB.1.raw
  modified_base (306)..(306): a, c, t, g, unknown or other
  misc_feature (306)..(306): n is a, c, g, or t
  modified_base (363)..(363): a, c, t, g, unknown or other
  misc_feature (363)..(363): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttagtttttaaaggtgtccagtgtgaggtgcagctggtggagtcggtgggggacgtcgttggtccaggccggtcggggggtccctggacgactcgtccgtgtgcacgtcctcgtggtacttccacctttctaagttatttangtactatgctacgtcgggtccgccgaggcctacggaagggacggacgtaggaacgtntcgtcgtacgtaaggttaattaggaaacgttagcgtaacgaaataatataattaatatacgtacgtaaactcgtaggtaggaacggactaacgtaattacccaacgttacgttacccgaaccggaaacggtaaacttaacgttaacccgaaaacggtaaccctacggtacttaacgttacttacccgttaaacgaaagttccggggaacaccggtacctaggtaacgacgtacggtaacgggaacggtacgtcccggtaattacggtaatttaccgttaggtaagggtagggaagggtacggggtaacggtacgggtttaaaaggtacggggttaaacgggtttagggggtcgggttaccgggggaacggtaacggggg

SEQ ID NO: 267414 - DNA, 608 bp, Homo sapiens
  misc_feature: GYAE6OF01CHH1N.28.57.F02.1.454.CMB.1.raw
  modified_base (424)..(424): a, c, t, g, unknown or other
  misc_feature (424)..(424): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctattttaaaggtgtccagtgtgaggtgcagctggtggagtcgtgggggagcttggtccagccgtggggggtccctgagactctctgtgcagcctctgattcaccttcagttatttatgctatcgctacgtggggtcccgccgaggtcctccggaaggggaacgggactaggtaaattagacgttctacgtaggtaattaagaagtaaagtcgacgtaaataaacattaagtaattagtagacaaaacttcgtagtagtacgggnaagtactaccacactctacgaggaactaactacaagacagtctgtatctanaagtcggacatccgtagagtacgtcaggacgacgtacggcgttagtagttagttacgtagggtaggaggtagggaacggtacgggttaaagtgggtaaacggttaggggtacggtcggggtacaaccgggggg

SEQ ID NO: 267415 - DNA, 694 bp, Homo sapiens
  misc_feature: GYAE6OF01BGYFR.28.57.F02.1.454.CMB.1.raw
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtcgtgggaggaggagcccccgccctgggtttcccaggtcgttctcatttggtgatccagcactgcacacagaagagtcatgacggacgtttgggctgagctgggtttccttgttgctattttaaaggtgtccagtgtgaggtgcagctggtggagtcgtgggggagcttcggtccagccgtgggggtccctgacgactctccgtgtgcagctctggattcaccttnagttatttatgctagtcgctacgtcgggtccgccaggtcctaccgaggggaacggacgtaggaactagtcgtactcgagttactagaacgttangacgtaanatatatagtatgactaaactcgtagtaggaacggcaaggtacttaccaacgtacttccggacccgtaaaggggtaccttaaacgttcccgaaaaggtaccctacggtacgttacgtaacttcttaacggaaaggttcggaaccgtcgtacccggttgaaacgtcggtacttaggggaaccgtacgtacccggggtatttacgggtatttaaacgttaccgggagggttacggggaaaggtacggggtaacggtagggttaaacggttaccggggtaaggtttacgggggttgtacccgggggcctaaaccgggggg

SEQ ID NO: 267416 - DNA, 723 bp, Homo sapiens
  misc_feature: GYAE6OF01BZ8E8.28.57.F02.1.454.CMB.1.raw
  modified_base (424)..(424): a, c, t, g, unknown or other
  misc_feature (424)..(424): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtgggggaggcttggtccaggccgtggggggtccctgagactctcctgtgcagcctctggtattcaccttcagttatttatgtctagtgcacgtcgggtcccgccgacggccgtaccggaaggggaacgggtacgtagggaatagtcgtcgtacgtaggttacttaaggaagtaagtgacgtaaataactaatatattatgactaaactctagtagaaggnagtattaccaactacgtccgtaccgaggtaacctaacgttaccaaagtaaccacgtctagtacttcttaacgaaagtcgggacacgtaccgtaggagtacgtaccgttagggaacggacccgtacgggtaccgtttaagttaacgtttaacggtttaacggtaggggttaacgggggtaagggtaacggggtaaacggggtaaaccggggttaaagggttttaaacggggggtaaacgggttttaacgggggggtttcggggttaacccggggggggtaacccgggtaaaccggggggg

SEQ ID NO: 267417 - DNA, 1004 bp, Homo sapiens
  misc_feature: GYAE6OF01CDWXI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtacttaagtttttaaaggtgtcctagtggtggtaggtgcagtcgtgggtggagttcggtggggggaggtcgttcggtccacggtccgggttcggggggttccctaggacgtaccttccgttccgtggtcgcgacgtccttcgtcggttaacttccgtaccttcgtaagtttatttacgtcgtacttagtcggtacctaccgggttccgggtccccggtaccggacgggtcccgtaccgggaaacggggggtaaacgggtacggttaaggtaaagttacgttcgtttacccgttaaggttaaaggttaaacggtttaaacggtaaaggtttaaacgtaacggtaaacgtaaaaacttaaacttaaatttaaagtttaactttaacgtaacgtaacgttaaaaccgtttcggtaaggttaaacgggtaacgggtacgtaacggttaacccgtttaccaaacccttaacggttaaccccgtaacgggtaaacggtaaaccgttaaaccgttaaaccgaaaacggttaccccgaaccggtttaccgtttaacgttaaccgttttaccgttaaaaccggtaaacggtaccggggtactaaccgggtaccgtaaggggtaacggttaaccgggtaacggttaccgggggaaaaccggtaccgggtaccgggttaacgttttaaccgttaacgtttaaacggttttaaccgggtagggggttaaacggggtaaaggggtaaaccgggtacggggttaaaaggggttaacgggttttaaaacgggggtacggggttttaggggggtaaaccggggttccggggggtaacccgggttaaaaccggggg

SEQ ID NO: 267418 - DNA, 970 bp, Homo sapiens
  misc_feature: GYAE6OF01B5MR1.28.57.F02.1.454.CMB.1.raw
tcagagtacgctatcacgaccggtgctcgatttagctcgatatagttgggtctgggagaggacgcccccgcccgtgggtttcccaggtgttctctatttggtgatcagcactgcacacagaagagtcagtggacggtaggtttgggctgagtcgttgggttttccttgttgtactttaagtttttaaaggtcgtccgtaggttggtggtagggtcgacgtaggtcggttggggtgggtacggttcggggtgggggggtacggtccggtttcgggacccgtacgggtcccggggttcggggggtccctggacgtccgttccgtcgtgtcggccgtacgtccgttcgtaggtaccttccgtacctttagtaagtttattagtcgtacttcgtcggaccgtacggtccggggtacccgaccggacggtccggtaaccgggaaaggggtaacggtacggtaaggtaacttcggtacgttacgtaacggttaaggttaaagttaagggtaaaagttaacgtaacggaaacgttaaaacttaataagtttaaactttaagttaacgtaaccgtaaacttaacgtcggtaaggtaacgggtaacggtacgttaaccgttactaaccctaaccgttaccgttaacccgggtacggtaaaacccggttaacttaaacccgtaaaaccccgaaaggttaacccgtcgtttaccgttaagtttaaacccgtttaacgttaaaccgggtaaggggtcccgaaccggtacgggtaaaccccggggttaaggaacccgggttacggtaaccgggtaacggggtaccggtaaccggtaccggtttaagttacgttaaaccgggttaccgtaaggggtaacggggaagggggtaacggtaaaccgggtaggggtaaccggttaaaggttacgggttacccggggggttaggggtacggggacccggggtaacggggttaccccggg

SEQ ID NO: 267419 - DNA, 975 bp, Homo sapiens
  misc_feature: GYAE6OF01DPDLY.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcagtgacgggtagtttgggctgagtcgttgggttttccttgttgtcttaagtttttaaaggtgtcgagttgtaggaggtgcgaggtcgtgggtggacgtggtgggggagtcgttcggtaccgacgtccgggttcggggggtccctggaacggtcttcgtccgttggtcgcgaccgttccgttcgtacgggtactttacccgtaaccctttcgtaaaggtttaagttttaatacgggtccttaacggttacggtcccgtaaccgggttacgggggttccccccgtaaccggacgggtacccggttaacccgggaaaggggggtaaaacggtaccggtaacggttaaacgttaagttcccggtttacccgtaacggttaaagggtttaacggttaaaaacggtaaaacggttttaaaagtaacgggaaaaccttaaaaaccggttaaaaacgttaaactttaaaagtttaaaaccgtttaagggtaacttaaacccggtttaaaaaccgttccggttaaggtaaaacggggaaacggtaaccggttaaggttaaccttaacccgtaaaccgttaaccgttaccggtaaaccggtaaacgggtaaaccttaaacgtaaaccggtaaaaccgaaaccgttaccgtacgttaaccggtttaattaaccggtaaaccgtaaggttaccgggacgtacggtaccgtaggaacgtacgttaacggacgtaaacgggcgtaaccgggttactaggttaaacgttaacggttacggtagggtaggggaaggtacgggtaacggtaagggttaacgttacgggtaacgggttagggttacgggtacgggaggtaacccgggg

SEQ ID NO: 267420 - DNA, 843 bp, Homo sapiens
  misc_feature: GYAE6OF01DA02B.28.57.F02.1.454.CMB.1.raw
  modified_base (357)..(357): a, c, t, g, unknown or other
  misc_feature (357)..(357): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttggggctgagcgttgggttttccttgttgcttaatttttaaagggtgtccagtgtgaggtgcagtctgggtggagtcggtgggggaggtcttcgggtcccaggcccggttcgggggggttcccctgaacggtccttccgtccgtggtcgccacggtcccttgtggtacttcctaccctttagtagtttatttagtctcttatcgctacgtccggggtcccnccgacggccgtaccggaaggggaaggacgtaggtaatacgttgtctacgtaggttaaacgtaagtaaagtaataggaacgtaaataaacgtattaataatttacaggtaactaaacgtcgtaggtagggaacggtatacgtacgttacaaccgtacttccgtaaccggaacgggtaaacccttaacgttaaacccgaaacgtaaaccggacgttaaccgttagttaactttaccgtttaaacgaaacggttccgggttaacaacccggtaccgttaagggtaaacgggacgggttacgtaacgggaaaccgggtacccggaaccgggttaacctttttaacgggtaaaccgttttaaagggtttccgggttagggggtttacgggaaaggggtacggggtaaacgggttaggggttaaacggggtttaaggggttaacgggggtttaggggtttccgggggacggggttaaaccgggtccgggggg

SEQ ID NO: 267421 - DNA, 846 bp, Homo sapiens
  misc_feature: GYAE6OF01ELSJO.28.57.F02.1.454.CMB.1.raw
tcagagtacgctatcacgaccggtgctcgatttagctcgatatagttgggtctgggagaggacgcccccgccctgggtttcccaggttgttctctatttggtgatcagcactgcacacagaagagtcatgacgggtagtttgggctgagtcgttcgggtttttcctttgttgtacgtttaagtttttaaagggtcgtacctaggttggtggtagggtgctaggtcgtgggtgggtaggtcggtggggggtaggtccgttcgggtccgacgggtcccgggttcgggggggtccctaggacgtacctccgttccgtggtcgcgtacgtccttcgttcggtaaccttctaccctttacgtagtttattagtcgtacttagtcgtacgtacggtccggggtcccaccggacgggtcccaacggggaaccggggtaagggtaccgtaagggtaattacggtcgtacctaggttaaacggttaagttaaagtaaaggttaacgtacggtaaacgtaaaactttaaagtaatttaactttaaattaacggtacctaacgtaaacgtgtttacgggaagggtacgtactacggttaacctcccgaaatcgtaccctaacggtaaacggtaacctaacttaaccgaaagtaccaccgttacttaagtcttaccgtaaacgtacggtggaactaaccgggtacgtaacggtacgggtaacgtcggtaaggaccgggtaaccgtacggtagttattaaacgttacgttaggttacggggtaagggtggagggaacgttagggtaacggttaacggttaaggggttaggggttacggggcgggtccggtaacccgggg

SEQ ID NO: 267422 - DNA, 702 bp, Homo sapiens
  misc_feature: GYAE6OF01BB3SC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtggggggaggcttggtccagccgtgggggggtccctgagactctcctgtgcagcctctggattcaccttcatatttatgctatgcacgtggtccgcaggctccgagggaagggctaggatagtgtctacgaggtaattagaagtatgacgaaataacaattataatttatacgtactaaacttcgtaggtaggaaaggtcaagtattaccaaccactcctacggaacgggtaacctaaagttacccgaaagaacccgaacgtaccgttaggttaacttaccttaacgtaaaggtacggggtactaacggtcccgttaggaagtacggtaccgtagggaaccggaaccgtaaccgggtcgttacgttaaacgttaacgtttaaccggttggggttagggggaagggtaacggggtaacgggacgggttaaaacggtttacggggtaaacgggtttaaggggggtttacggggtcggggggtacccgggtaaccgggggg

SEQ ID NO: 267423 - DNA, 794 bp, Homo sapiens
  misc_feature: GYAE6OF01BNL2L.28.57.F02.1.454.CMB.1.raw
  modified_base (259)..(259): a, c, t, g, unknown or other
  misc_feature (259)..(259): n is a, c, g, or t
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggtagtttgggctgagtcttgggtttttccttgttgtcttaagttttttaaaggtgtccagtgtggaggtgcagcgtgggtggagtcgtgggggaggtcttcgggccagccggtggggggtccctgacnctctcctgtcgcgacgcctcgtggtacttcctacccttntagtttatttatgtcttatacgcctacggtccgggtcccgaccggacggtccgtaccgggaaggggaacggtacgtaggaaacgttgtcgtcttaagtaggttaataaggtaagtagtacggataaactaactattaataacgtttacagtaacctaaactcgtaggtaggaacgggtctaagttaccttaccgaacctcgttacccgacggaaaggtaaacctaacgtaacccgaaaacgaaccgtccgttacgttacgttaaccgttactttaacgaaacggtcggacgtaaccgtaccgaggaaccggtacgtaggttaccgggacgggtaaccgtacggtggttaacgttaaacgttttaagggttaccgtggggggttaagggaacggggttaaacggtaacgggtaaaccggtttaacgggttaaacgggggtaacggggtttaggggggttttaacggggcccggggggttaaaccgggtacccggggg

SEQ ID NO: 267424 - DNA, 746 bp, Homo sapiens
  misc_feature: GYAE6OF01ASOFM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtggggggagtcttggtccaggtcccggtcgggggggtcccctggacgtacctcctcccgtggtgccaggtcccttcgtggtactttcctaccctttctaagttatttatgtctatcggctaccggtcggggtcccgaccggacggtcctaccgggaagggggaacgggtacgtaagggtaacttgttcgttcgtacgtaaggttaattaacggtaaataagtcgaactaaataaactattaattattatacgaactaactcgttaggtaggaacggtctaacgtattacccgaaccttacgtacccgacggtaacggtaaactaacgttaaccaacgtaaccacgtacctattcttaacctaacgtaaggcgggtacacgtaccgtagaagcgtccggtaggaaccggtacgacggttagtaacgtagtttaaggttacggtaggggaggggaacggtaagggaacgggttaggttaaagggttacgggggttaaacggttaggggggttcggggttccggggaccggtaaaccgggg

SEQ ID NO: 267425 - DNA, 691 bp, Homo sapiens
  misc_feature: GYAE6OF01AQES1.28.57.F02.1.454.CMB.1.raw
  modified_base (145)..(145): a, c, t, g, unknown or other
  misc_feature (145)..(145): n is a, c, g, or t
tcagagtacgctatcacgaccggtgctcgatttagctcgatatagttgggtctgggagaggagccccccgccctgggtttcccaggtgttctcattttggtgatagcactgcacacagaagagtcatgacggaggtttgggtcgngagcgtggttttccgtttgttgtcttatttttaaaaggtttaggtcctagtgtgaggtgtcagcgtggtgggtaggtcgttgggggagggcttcggttccgacggccgtcggggggtcccgtcgagacctcctcctggtgcgacgccgtcgtggacttctacccgttctagttatttatgctatgctacgtcgggtaccgcccaggctcccgaaggggaaggacgtggaagtatgtctacgaggttaagttagaagtaagtgacgtaaataaacatattattatcgataaaccgtgtggtaggaaggctagtacttccaccgtatccgtacgaaggtactaaactaccgaaacgtaacaccgtcgttagtctactttacgaagtgggcacgcgtaggagacgtgtagacggaccgacgtcgttagtagtttaacttacgggtgggtagggaagggtaaggggtaggtaaccggttaaagggtttacgggtaaagggtttacgggggtttagggacccggggggttacgggtaaccggggtaccggg

SEQ ID NO: 267426 - DNA, 789 bp, Homo sapiens
  misc_feature: GYAE6OF01COS8E.28.57.F02.1.454.CMB.1.raw
  modified_base (177)..(177): a, c, t, g, unknown or other
  misc_feature (177)..(177): n is a, c, g, or t
  modified_base (683)..(683): a, c, t, g, unknown or other
  misc_feature (683)..(683): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggngtccagtgtgaggtgcagcgtggtggagtcgtgggggagcgttggtccagccgtgggggtccctgagactctccgtgtgcacgcctcgtggtacttccacctttcagttaacttttatcggtacttagtcgtaccgtacggttcgggggtccccaccggtaacgggtcccgttacccggaaagggggaaacgggtaccgttagggtaaacttagttcgtactacgtaaggttaagtaaaggtaaagtaagtacgaacgtaaattaacaagtttaataaattacgtacgtaaacccaaagtttcgtagggttaaacggaacggggtactaacggtacttacccggtaaacctaacgtaccttaaccccgggaaagggttaacctaaaaccgttaaacccgaaacggtacctaaccggttctaacgttacttaccgttaaacgtaacggtaccggtcgaaccgtaccgaaggtacgtacggtactaggggaaccgtacgtacccggtnttagttaaacttaacgggttagacgggtaaggggacggtaaaggagggtaacggtaacggttaacggaacgggtttagggtacggggtcgggaaccggtaacgggg

SEQ ID NO: 267427 - DNA, 854 bp, Homo sapiens
  misc_feature: GYAE6OF01DD6JT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtgggggagtcgttggtccagccgtggggggtccctgagactctcctgtgcagcctcgtggacttcacctttcagttatttatcgctatgactacgtcggggtccgacccgacggtccgtacccggaagggggaaacggggtaaccttaggggtaaatttgttacggttcctaccgtaaggttaaacgtttaaaggaaagttaaagtacggaacggtaaaattaaaaccgaatttaaagttaaatttacgttacggaaccctaaaactttcgtaggttaaggaaacggggcctaagggtaactttacccgaaacccttaagttaccccgtaaccggaaaggggtaacccttaaaaccgtttaacccggaaaagtaaccccgtacgtacgtttaacgactttttacccgttttaaacgaaacgggttttcggggaaccctaaacgggttacccgttagggtaaacggcggtttaacggacgggtaaaacgggcccgtaaacgggttcctttaagggtaaacttttacgttaaaccggtagggtaaggggggtagaaacggggtaacgggtaccgggtttaaaaggtttacggggtaaaacggttgggggggttttaacgggtcggggggccccgtaaaaccggggggg

SEQ ID NO: 267428 - DNA, 659 bp, Homo sapiens
  misc_feature: GYAE6OF01DQQIE.28.57.F02.1.454.CMB.1.raw
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagagtacgctatcacgaccggtgctcgatttagctcgatatagttgggtcgtgggagaggagcccccgccctgggttcccaggtgttctcatttggtgactcagcactgcacacagaagagtcatgacggaggtttggggctgagcgttgggttttccttgttgcttattttaaaggtgtcagtgtgaggtncagctggnggagtcgtgggggagcgttggtccgagccgtggggggtccctggacgctctcctgtgacncgcctcgtgtcttcaccttcattatttangtctatgcacgtcgggtccncgagctcggaagggacggactggaatgtgtcacgtagtagtagaagtagtcgaagtaaataactagtaattatactacgaactaacttcgtaggaaggtaacggtacaaggttattaccaacctacgtacctacggtaacggtaactaaacttaaccgaaacgtaacctacggtaccttagtactacttaacgtaaacgtggacgtaacgtcgaggtagacgtagtaggacggtacgacggtacgttagtagttacgtttacgttaaggggtaggaacgggtagggaacggtacggtaacggttagggttaacgggttagggtacggggtccggggtcgggaacgggg

SEQ ID NO: 267429 - DNA, 662 bp, Homo sapiens
  misc_feature: GYAE6OF01CBT9L.28.57.F02.1.454.CMB.1.raw
  modified_base (401)..(401): a, c, t, g, unknown or other
  misc_feature (401)..(401): n is a, c, g, or t
  modified_base (520)..(520): a, c, t, g, unknown or other
  misc_feature (520)..(520): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcgtttgggtcccgaggccgttcggggggggttcccctgggaacgaccttccttcccgtggtgccagccctcgtggacttccaccctttcagttatttatgccttatgctacgtgggtcccgccgaggcctccgaggggaacgggtacgtagggaattagtgtctacgtaggtattagaagttaangacgaaataacatataattatgactaaactcgtggtaggaaggacgagtacttaccaacctatcctaccgaagggaacctaacgttaccaaagtaccacggtactagttactaccttanaagttcgggacagtcctaggaagtacgcggtaggaacggaccgtcggtagttagttagttagttacggttcggtaggggacgtaggggacgtaacgggtagttacggaaggttaggggttcggacggggtcggtaaccgggg

SEQ ID NO: 267430 - DNA, 760 bp, Homo sapiens
  misc_feature: GYAE6OF01A4CQZ.28.57.F02.1.454.CMB.1.raw
  modified_base (515)..(515): a, c, t, g, unknown or other
  misc_feature (515)..(515): n is a, c, g, or t
  modified_base (606)..(606): a, c, t, g, unknown or other
  misc_feature (606)..(606): n is a, c, g, or t
  modified_base (645)..(645): a, c, t, g, unknown or other
  misc_feature (645)..(645): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggagtcgttggtccagccgtggggggtccctgacgactctccgtgtcgcgacgtcctcgtggtacttcctacctttctaagttattttaagtcgtctaagtcgtaccgtaccggttcggggttaccccgaccggacgggtcccgttacccggaaagggggtaaacggggtacgttaagggtaaacgttagttcggttacccgtaagtaaggttaagttaaacggtaaagttaacgtaacggtaacgtaaaataaacttaataatttaagttatacgaactaaacgtctacggtagaacggtanagtacttccaacctcttaccgaacggtaaggtaaccctaaaacttaccgaaactaaccgtaacgtcttaacgttacttaccgtagtaacgngggacaccgcctaggagtccgagtacggcgacgtacggngttaagttaccttaggttaccgttagggaggggaacgacggggaaccgttaggggttaaacgtttcggggaaacggggtttccggggtcggggtccggggtaaacccggacgggg

SEQ ID NO: 267431 - DNA, 847 bp, Homo sapiens
  misc_feature: GYAE6OF01BNM6R.28.57.F02.1.454.CMB.1.raw
  modified_base (224)..(224): a, c, t, g, unknown or other
  misc_feature (224)..(224): n is a, c, g, or t
  modified_base (726)..(726): a, c, t, g, unknown or other
  misc_feature (726)..(726): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagttttaaaggtgtccagtgtgaggtgcgagcgtggtggagttcggtagggggngtcgttcggtccgaggtccggttcgggggtccctaggtaacgtccttccgtccgttggtcgccgtacggtccttcggttcggtactttccctaacctttcgtaagtttaactttagtcgtacttagtacgtccgtacggttccggggtaccccaccggtaccgggtcccgtaaccgggaacgggggtaacggtaccgttaaggtaattacgtcgttaccgttaaggtaaggtttaaagttaacggtaaaagttaacgtacgaaacggttaaaactaacgttaagttaaactttaacgttaagtaaccggttaaaccctaaaacgtttccggttaaggtaaacgggtaacggtacgtaaccggttaacttaaccccggaacttacccgttaaccggtaaccgggtaaacggtaaaacccttaacttaaacccggaaaagtttacccgtaacgttacgtttagttaaccgttacctaaacggtaagggtccaccgtacgtacgnggaacgtcgacgaacggacgtacgagttacgtagttaccgttagtcggcggtaaggaacgggtgaacgggtacgttaaggttacggtaaggtttagggtcgggaacgggtcgtaaccgggg

SEQ ID NO: 267432 - DNA, 852 bp, Homo sapiens
  misc_feature: GYAE6OF01DMQ62.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagtcgttgggttttccttgttgcttaagtttttaaaggtgtccagtgtgaggtgcagctgggtggagtcgtgggggagtcgttggtccaggtccggtggggggtccctaggaggtactcgtcctgtcgcacggtcctcgtggtacttcctaccgtttnaagtttatttagtcgtactatacgaccgtaccggttcggggtacccgccgtaacggtcccgttacccggaagggggtaacgggtaccgtagggtaaacttagtcgttctaacgtaaagggttaattaaggtaaaagttaaagtacgtaaacgtaaaactaaacgtaagttaaacgttaagttaaacgtacggtaaacctaaaaacttccggttaaggtaaacggaaacggggtactaaacggttaaccttaaccaaacccgtaacttaccggtaacccggtaaacgggtaaccctaaaacgttaacccgaaaaacgtaacccgtaacgtacgttacgttaactaaccgtttaacgtaaaggtacggacgtaacgtacccgtaggtaacgtacgagtaacggacggaaccgtacggtacgttagttaacgttaacgtttacggtaacgggtaggggtaaacgggtaacgggtaagggtaaacggtaaacgggtttaggggaaaccggtttaaggggggtttacgggtacgggggtccgggtaaaaccggggg

SEQ ID NO: 267433 - DNA, 421 bp, Homo sapiens
  misc_feature: GYAE6OF01CICA2.28.57.F02.1.454.CMB.1.raw
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (392)..(421): a, c, t, g, unknown or other
  misc_feature (392)..(421): n is a, c, g, or t
tcagagtacgctatcacgaccggtgctcgatttagctcgatatagttgggtttggggtacgatttgatgttacctgatgcttagaggcttttcctggaagcaggcatttgttgcttcagcaccgtagtgcctcgtcatcacgcctcagccttgattttccggatttgcctggaaaaccagcctacacgcttaaaccgggacaaccgtcgcccggccaacatagccttctcccgtccccccttcgcagtaacaccaagtacaggtaatattaacctgtttcccatcgactacgcctttcggcctcgcctttaggggccgactcacccctgccccgtattacgttggacaggaacccttggtcttccggngagcgggctggcaaggcncagtannnnnnnnnnnnnnnnnnnnnnnnnnnnnn

SEQ ID NO: 267434 - DNA, 906 bp, Homo sapiens
  misc_feature: GYAE6OF01CN364.28.57.F02.1.454.CMB.1.raw
tcagagtacgctatcacgaccggtgctcgatttagctcgatatagttgggtctgggagaggagccccccgcccctgggtttcccaggtgttctcatttggtgatcagcactgcacacagaagagtcatgacggagtttgggctgagcttgggttttccttgttgcttaagtttttaaaggtgtccagtgtgaggtgcagcgtggtggagtcgtgggggagtcttggtccaggtccggtcgggggtccctgacgactcctcctagtcgacacgtcctcgtgtactttccacccgtttcgtaagttacttttaagtgtacttagtcggacctaccggttccgggggtccccgacccggacggtacccgtacccggaaagggggtaacgggtaacgtagggtaaattacggttcggttaccgttaggtaaagggttaattaaacggtaaaaggttaaacgttcggaaacgttaaaaactaaacgtaatttaaaagtttaaagtttaacgtaaccgtaaaccgtaaaacccgtttacggttaggttaacgggtaaacggggtaacccgtaagtttaacccgtttacccaaacccgttaccgtttaacccccgtaaaccgggtaaacggggtaaaacccttaaccgtttaaaaccccgaaaaccggtaacccgtaaccggtaccgtttaacgttaacctttaaccgttaaacgaaagggttcgggaacctaccgggtaccgtaaggtaacggacggtaccgtaaggaacccgggacgtaacgggtcttacggtttaagtacgttaaggtcggggttaagggaacgggtaagggtaacgtaccggggttaaaggttacgggtaaacggggtttgggggttaacggggtcccgggggtaacggtacccggggg

SEQ ID NO: 267435 - DNA, 673 bp, Homo sapiens
  misc_feature: GYAE6OF01BCJLS.28.57.F02.1.454.CMB.1.raw
  modified_base (272)..(272): a, c, t, g, unknown or other
  misc_feature (272)..(272): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttcctgttgctattttaaggtgtcagtgtgaggtgcagctggtggagtcgtgggggagcttggtccagtcctggggggtccctgagactcttctgtgcagcctctggattccaccttcagtntttatgctatgcacgtcgggtcccgccagggtcctaccgaggggaacgggactaggaacttatgtctacgtagggttaatttaggaagttaatcggacaaagtaacagttaatattatagactaaactgtaggtaggaagggactaaggtattcccgaactacttccgtaccgaagggaacctaacgttaacccaaagggaaccctacggtaccgttagttaacttaccgtttaaccgaaaaggttcggggacctaacggtacccgtaaggacggtacgccggttagggaacggtacaccgggcttaggtaacttaagttacggtggtaggggtaaggaaggacgggtacggtaaggttagggaaacgggttagggtttgggtaccggggcgtaacggggg

SEQ ID NO: 267436 - DNA, 670 bp, Homo sapiens
  misc_feature: GYAE6OF01BDULM.28.57.F02.1.454.CMB.1.raw
  modified_base (273)..(273): a, c, t, g, unknown or other
  misc_feature (273)..(273): n is a, c, g, or t
tcagagtacgctatcacgaccggtgctcgatttagctcgatataggttgggtctgggagaggagcccccgccctgggtttcccaggtgttctcatttggtgatcagcactgcacaacagaagagtcatgacggagtttgggctgagctgggttttccttgttgtcttatttttaaaggtgtccagtgtgaggtgcagctgggtggagtcggtgggggaggtcttggtccagccggtggggggtcccctggacgactctcctgtcgcacgcctntggattccacctttcagttatttatgctatgcacgtcgggtcccgcacggctaccggaaggggaacggacgtaggaatagtgtctacgtaggtaattaagaagtaatgacgaataaacatataattatgaactaaactctaggtagaaggacagtacttcacctatcctacgaagggtaacctaaacgttaccgaaacgaactacgtacgttagtaacttaccttaacgaaagtcgggtacacgtactacggaagtcgtacgtaaggacggtaaccgagggtactacgttaaacgttagtttaaccggttggggtaagggggaaggaggggtaacggaaggttaaagggttacgggtaacggttaagggggttcgggtacgggggtcgtaacggggg

SEQ ID NO: 267437 - DNA, 683 bp, Homo sapiens
  misc_feature: GYAE6OF01EWTS9.28.57.F02.1.454.CMB.1.raw
  modified_base (203)..(203): a, c, t, g, unknown or other
  misc_feature (203)..(203): n is a, c, g, or t
  modified_base (320)..(320): a, c, t, g, unknown or other
  misc_feature (320)..(320): n is a, c, g, or t
tcagagtacgctatcacgaccggtgctcgatttagctcgatatagttgggtctgggagaggacgccccccgccccgttgggtttccccaggtgttctctatttggtgatcagcactgcacacagaagagtcatggacggtaggtttgggtcgtgagtcgttcggttttccttgttgtacttaagttttaagtgtctagtgtgngtgcagctggtggagtcgtgggggaggcgttggtccagccgtgggggtccctgagactctcctgtgcagcctctgattcaccttctagttatttatgtctatgctacgtcggtccgngccacggcggtaccgacggaagggacgtagtaagtacgtacgtacgtacgtaggtaagttaagtaagtagtacgaacgtaaacgtaaactaataagttaattagtacgtaactaactacgtagtaggacgtacgtaacgttactacctaactacgtaccgtaacggtaacgaaacgttaaccgtaacgtaaacgtaaccgtaccgtacgttacgttacttaccgtaacgtaacggtacgacgtacgtacgtacgtacgacgtacgacggtacgacggtacgtacgtacgttagttagttacggtagggtaggtaaggaacggtacgggtaacggttaggtaacggtaagggttagggtacggg

SEQ ID NO: 267438 - DNA, 553 bp, Homo sapiens
  misc_feature: GYAE6OF01B0K7Y.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattatgctatgcactgggtcccgccaggctccagggaagggactggaatatgtctcaggtattagaagtaatgacgaaataaacaattaataattatagtacaaaactctaggtgaaaggggcaagaattcaacctatctccaaggacaattcccaaagaaccacgctgtatcttacaaatcgggacagcctgagagctgaggacaggctagtataattacgtgtgggagaggagcggaaagttgggaaacgttaggggttgtagggggccgtaagggg

SEQ ID NO: 267439 - DNA, 709 bp, Homo sapiens
  misc_feature: GYAE6OF01CLQU6.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggaggcgttggtccaggccgtggggggtccctgacgactctcctgtgcagcctctggtattccaccttcaagttattttatgtctatcgctacgtcggggtcccgccgaggcctccggaaggggaacggactaggtaaatgtgtctacgtaggttattaagaagtaatgacgtaaataacattaatattatagaactaaactcgtagtaggaagggcagtacttccacctatacctaccggaaggtaacaaacgttaccgaaagaaccacggtacttacggttaacttaccgttaacgtaaaggttcgggacaacggtcccgtaaggacgtacgtacgttaagggaaccggtaccgtaaccgggtcgttaagtaaactttaacggttacggttaggggtagggggaaacggaaggggttaccgggaaaggggttaaggtttaaggggtaaacgggtttgggggtttacggggaccggggggaaccggtaacggggg

SEQ ID NO: 267440 - DNA, 752 bp, Homo sapiens
  misc_feature: GYAE6OF01CBZXH.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtggggggagcgttggtccagccgttggggggtccctgacgactctcctgtgcacgcctcgtggtattccaccctttactaggttaattttatggtcttaagtcgtaccgtaccggttcgggggtccccgacccgacgggcccgtacccggaagggggaaacggggtacgtagggtaaatacgttggttccgtacgtaaggtaatttaaaggaaagttaaagtacggaacgtaaataaactaagttaattaagtttaagtacgtaaccgtaaaacttacgttggtaggaaacgggtctaaggtacttacccgaacctactcgttacccggaagggtaacctaacttaccgaaacgaaccaacgtctagttactaccttaagaacgtcggaccgacggtcctaggacggtacgcgtaggaacggaccgacggtacgttagtaagttacgttacggtgggtaggggacggtaagggtacgggtaagggtaacggttacggggtaacggtttagggggttcggggtacggggtcccgggtaacggggg

SEQ ID NO: 267441 - DNA, 808 bp, Homo sapiens
  misc_feature: GYAE6OF01EKWTT.28.57.F02.1.454.CMB.1.raw
  modified_base (321)..(321): a, c, t, g, unknown or other
  misc_feature (321)..(321): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagtcgttggtaccgaggtccggttcggggggtcccctggacgtaccttccgtccgttgtcgctacgtccttcgtggtacttccctacctttactagttaattttagngtacttagtcgtacgtaccggttcggggtcccgaccgacggtccgtaccggaagggggaacgggtacgtaggtaacgttagttcgtacttacgtaaggtttaaatttaacggaaaagttaagtacggaaccggtaaaataaactaatttaatttaatttaacgtacgtaacctaaaacgtcgttaggtaacgggtaaacgggcctaaggtacctttaccgacctatacccgtaccggtaaacggtaacctaacgtttaaaccgaaacgtaaccgtacggtaccgttaagttaccgtactttaacgaaacggtcggtaaccgtacggtaccgttaggaggtacgtacggtaaggaccggtacgtaccggtacgttagtaaccgttacggtttaccggtgggttaaggggaagggtagggtacggtacggggttaaacgttcgggtaaacggggttaggggtttcgggtacggggaccgggtaacgggg

SEQ ID NO: 267442 - DNA, 776 bp, Homo sapiens
  misc_feature: GYAE6OF01ACCQ8.28.57.F02.1.454.CMB.1.raw
  modified_base (202)..(202): a, c, t, g, unknown or other
  misc_feature (202)..(202): n is a, c, g, or t
  modified_base (622)..(622): a, c, t, g, unknown or other
  misc_feature (622)..(622): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttaatttttaaaggtgtccagtggtgaggtgcagcgtggnggagtcgtgggggagcgttggtccaggtccggtggggggtccctggagacctcgtccgtgtcgcagtcctgtggtacttccaccgtttcagtttatttagtcgtctatcggtcctacggttccgggtccctaccgaacggtcccgtcggtaagggggaaaacgggtcgtaagggtaacttagttacggttacccgtaggttaagggttaacgtttaaaaggaacgttaaagtacggaacggtaaaacttaacgtaaagttatttaacgtacttaggaacctaaacgttcgttaggtagggaacggtatacggtacttaccgaactacgttaccgtacccggaaaggtacccttaaacggtacccaaaaggaccgtacggtactcgttaacttccgtaaagtaacggtcgggacaccggtnaacggaggttacgacggtaagggaccgtaacggcggttaacttagttaaacgttaacgtttaggtacgggaaggggtaggttaacggacggttaacggttaaagggttacgggtaacggggtttaggtacgggggaacgggtcggtaacggggg

SEQ ID NO: 267443 - DNA, 879 bp, Homo sapiens
  misc_feature: GYAE6OF01BFSFQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatcgacggagtttgggctgagcgtggtttcttgttgctattttaaggtgtcagtgtgaggtgcagctgggtggaggtcggtcgggggaggcgttcgggtcccaggccgttcggggggttcccctggagacgttcctccgttggtcgcgacgtaccttcgttaggtactttcctaacctttacgtaacgttacgttttaactcgtacttacgtacgacccgtaaccggttccgggtcccgaccgtacggtccgttaaccggaagggggaacgggaaccgtaggtaaattacgtcggttaccgttaccggtaaagggtttaaaggttaaagtaaaacgtttaacggtacgtaaacgtaaaacttaaaccgtaattaactttaagtttaaacgtcgtaacctaacgttccgtaggtacggtaacgggactaacggtaccttaccgtaacccgtacgttacccgacccgggtaaagggaaccctaaagttacccgaaaaggtaaccctaccggttacgtttaccgtaactttaccgttaaagtaacgggtcggtacctagggtaccctaagggtaagtaacggcggttaacggggaacggggtaacctccgggttaagttacgggtttaaaccttaacggggttacggttaggggtacggggaaacggagggggttaacgggtaacgggttaacggttaaccgggggtaagggttttacccggggggtttacggggtacccgggtggggtaaccccggg

SEQ ID NO: 267444 - DNA, 865 bp, Homo sapiens
  misc_feature: GYAE6OF01CCGHO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtcttaattttttaaagggtgtccagttgtgaggtgcaggcgtgggtggagtcggtgggggagtcgttggtccgaggcccggttcggggggtcccctaggacgtaccttccgtccgttggtcgcgacgtccttcgtggtacttccgaccttactagttatttatgtacttagtcggcctacggttcgggtacccgccgtacggtccgtacccgggaaagggggaacgggtaccgttagggtaaacttcggttacgtcgtaacgtaaggtttaaagtaaacggtaaaggtaactacggaaacgttaaaacgtaaacttaaggtttaaatttaaacggtttaacgtaacggtaacctaaaacgtttcgggttaagttaaacgggaaacgggtacttaagtacctttaaccaaccgtaaccgttaccgtacccgggaaaggtaaccctaagttaacccgaaaaggtaccaacgttattacgtattaccttaaaggaagttccgggtaccaccgtcgtaagggagtacgtaggtacgggaaccggtaccgtaacggttactttaaggtaacccgtttaagggtttaacgggtggggtaaagggggacggtaaggggtaacggtaaaccggggttttaagtaccggggggtttaacgggttggggttttacccgggggacgggggtaaccccgggttaaccgggg

SEQ ID NO: 267445 - DNA, 803 bp, Homo sapiens
  misc_feature: GYAE6OF01EU4L3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgctatttttaaaggtgtccagtgtgaggtgcagctggtggagtcgtgggggagcttggtccagccgtggggggtccctgagactctcctgtgcagcctctggattccaccttcagttatttatgtctagtgctaacgtcggggttcccgccgagggtccttaccggaagggggaacggggaccgtagggtaaacttagttcgttcttacgtaagggttaattaaggtaaagttaagtaggaaccggtaaaattaaactaatttaattaagtttaagtcgtaacctaaaacgttcgttaggtaagggaaaggggtactaaggttacttaccctaacctacttacccgtaccggtaacggggtaaacctaaacgttacccgaaaacgaaccgtaaccggtacttaacgttacttaacctttaacgaaacggttcgggacaacggtaccgtaggagtacggtacgtacggaacgggtaccgtacgggttacctaggttaaccgttaaggttttaaccgggttagggttaggggaaacggggtaggggaaacgggtaacgggggttaaagtttaacgggggttaaacgggttaaagggggggttttacggggtccgggggggtaacccggggtaaaccggggggg

SEQ ID NO: 267446 - DNA, 696 bp, Homo sapiens
  misc_feature: GYAE6OF01CRNKC.28.57.F02.1.454.CMB.1.raw
  modified_base (316)..(316): a, c, t, g, unknown or other
  misc_feature (316)..(316): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagcgtggtggagtcgtgggggagcgttggtccaggtccgtgggggtccctgacgctctcgtgtgcagcctcgtggtattccaccttcagttatttagtgtactatcgcacggtcgggtcccncgacggcctccgaggggaacggctaggaatntcgtctcgagttataggaatagtgacgaataacnttaatagttatacgaactagtcgtgtaggaacggctagtaccttccaaccttgtccgtacggaacggtaactaaccttacgaacgactacgtctacgttactaccgttaagaaggttcgggaactaccggtccgtaggaacgtacgcggttacgggaaccggtacgaccgggttcttaaggttaacgttaacgttacggggtggggttaaggggaacgggtaacggtaacgggggtaacggtttaaaggttaacgggggttaacccgggtttaggggggttaacccgggggtccgggggcccgtaaaccgggggg

SEQ ID NO: 267447 - DNA, 798 bp, Homo sapiens
  misc_feature: GYAE6OF01DWDPN.28.57.F02.1.454.CMB.1.raw
  modified_base (366)..(366): a, c, t, g, unknown or other
  misc_feature (366)..(366): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagcgttgggtttttccttgttgtcttaagttttttaaaggtgtccagtgtgaggtgcagcgttgggtggaggtcgtggggggagtcgttcgggtccaggcccggttgggggggttccccctggacgtaccgttcctcccgttggtcgccacggtcccttcgtggtacttcctaaccctttctaagtttattttatgacttactcgcgacggttcggggtcccnccgacggtccggtaccggaaggggaacgggtacgtaggtattattcgtcctaggtagttaagttaaggaaagttaatgaacgtaaataaacattaattaattaagtcgtaactaaacgttgtaggtagggaaacggtacgtaagtaacttaccacccgttaagttcccgtaaccgtaaacgggtaacttaaaccgttaacccgaaacggtaaaccctacggttaccttacggttaactttaccgttaaacgtaaacgggtccgggacgaaccgtaccgtaggacgttacgcggtaggaacggtaccggtaccggtacgtttagttaacttaggtttacggtaggggtagggaagggtaagggaacggttaacgggaagggtttaagggtaacgggtttagggggttacggggcgggttaccggaaccggggg

SEQ ID NO: 267448 - DNA, 705 bp, Homo sapiens
  misc_feature: GYAE6OF01EVN3E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttgggtccaggccgtgggggggtccctggagtactctcctgtgcagcctgtggtattccaccttcagttatttatgctatgctacgtcgggttcccgccgaggccttaccggaggggaacgggactagggaattagtgtctcgaggttataagaagtatgacgtaaataactatatattatagactaaactcgtagtaggaacggctagtactaccgtaacccagttaccgtaccgtaacggggtaaacctaaacgttacccgaaaacggtaaccgaccggtacgtttacggttaacttaccgtttaacgaaaacggttcgggacctaacggtcccgtaggacggtacgtacgttagggaacggaccgtaccggtagttacgttaattacgttaacggtcgggttaggggaaggtacgggaaggtaccggttaaggttacggggtaaacggtttagggggttcgggtacgggggccggtaacccggggg

SEQ ID NO: 267449 - DNA, 639 bp, Homo sapiens
  misc_feature: GYAE6OF01BVSPH.28.57.F02.1.454.CMB.1.raw
  modified_base (255)..(255): a, c, t, g, unknown or other
  misc_feature (255)..(255): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggagcttggtccaggccgtggggggtccctgaggactcctcctgtncagcctctggattcaccttcagtatttactgctatgcactgggtcccgaccaggcctaccgaaggggacggactggaatacgtgtctctaggtattaagaagtaactgacgaaataaacgataatattatagactaaactcgtgaaggtaaggcagacttcaacgtactccttacacgggaactaacttaccgaaagaaccaacggtccttagttacgtacttaacgaagtcgggtacgacggacctagaacggacgtacgtaggaacggacgaacggtcgtagttacgtaattaacgtggtaggggtaaggtacggaggtaacgggtaaacggttacgggtaaacgttacgggggttaggttcggggggtaccgtaacggggg

SEQ ID NO: 267450 - DNA, 722 bp, Homo sapiens
  misc_feature: GYAE6OF01BOLFF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtctatttttaaaggtgtccagtgtgaggtgcagctggtggagtcgtgggggagtcgttggtccaggccgtggggggtccctggagtactctccgtgtcgacacgcctcgtggtacttcctacctttcgtagttattttagtcgtctagtcgacctaccggttcggggtccccgaccgtaggccctaccggaaggggaacggacgtaggaaactagtcgtactacgtaaggttaattaaggaaagttatagacgaaattaacgattaattactatacgtaactaaacttcgtagtaggaacgggtactagtacttacaactacgtaccgtaacgaacgggtaactaacgttaaccgaaacgtaaccgtacgtacttacgttaacttccgttaaacgtaaggtacgggtaacgacgtaccgttaggaaggacggtaccgtaggaacggacgacgtacgtagttacttagttacggtagggtagggtacggagggtacgggtagggttaaacggttacgggtaagggttaaggggtggggtaaccggggcggtaaaccggggg

SEQ ID NO: 267451 - DNA, 731 bp, Homo sapiens
  misc_feature: GYAE6OF01DTJ4K.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctggagtcggttcggtttcgtgtaggcttaagttttaaaggtgtcagtgtggaggtgcagtcgtggtcggtagtcggtgggggagtcgttcggtccaggtccggtcgggggtccctggacgtcttcgtccgtgtcgcgacgtctacgtgtacttccgtaaccttgtaagttatttagtcgacttagcggtaccgtacggttccggggtcccacggtacggtaccgtacgggaaggggtaaccggtacgtaggtaagtacgtgtactacggtaaggttaactaaacggtaaatacgtacgaaacgtaaactaaagtacttaagttaattacgtacgaaacgttacgttacgtagaacggtacggactagtaccttaccacgtacgtccacggataacgtaactacgaacactgtagtcgtactacttaacgaagttcggactaacggcgtaaggacgtcgacggtacgacgtacgtacgttactagtaaactttcggttacggtagggtagggtaacggtaagggacggttaaccggttaaggttaacgggttaacggtcgggggttaacggtccgggtaaccgtacgggg

SEQ ID NO: 267452 - DNA, 891 bp, Homo sapiens
  misc_feature: GYAE6OF01CVRKQ.28.57.F02.1.454.CMB.1.raw
  modified_base (754)..(754): a, c, t, g, unknown or other
  misc_feature (754)..(754): n is a, c, g, or t
tcagagtacgctatcacgaccggtgctcgatttagctcgatatagttgggtctgggagaggacgcccccgcctgggtttcccaggtgttctcatttggtgatcagcactgcacacagaagagtcatgacggtagtttgggctgagtcgttgggtttttccttgttgtcttaagtttttaaaggtgtcctagtgtgaggtgcagcgtgggtggaggtcgtgggggaggtcgttgggtccaggtccggtcggggggtccctggacgtacctcctccgtggtcgcacgccgttcgtggtacttccgtacctttcgtagtttaactttagtctacctttaagtcggtacgtaccggttcggggtccccggaccgtaacggtcccgtaaccgggaagggggtaaacgggtacgttaagggtaaatacgttcgtacgtacggtaaggttaacgttaaggtaaagtaacgttaggaaacgttaaaactaaacgtaagtttaagttaagtttaaacgtacggtaaacctaaaccgttacggttacggtaaacgggtaacgggaacgttaacgttaacttaaccccgaaccgttaacgttcccgtaaaccggggaaaggttaacctaaaacgttaaccggaaaacgtacccgtaaccggttacgttacgttaaacctttaccgtttaacggaaaggttccggggacttacggacccggttaaggtacccgaaggttgacgggaaccgtacccggtaaaggttntaacggtttaaaagttcggtttaaacgggtggggaaaggggttaaggaaaccggggtagtttaaacgggtaaacgggttttaaccgggaacggggttttaagggggttcggggtaccgggggaaacccggtccgggg

SEQ ID NO: 267453 - DNA, 815 bp, Homo sapiens
  misc_feature: GYAE6OF01EN6P5.28.57.F02.1.454.CMB.1.raw
  modified_base (725)..(725): a, c, t, g, unknown or other
  misc_feature (725)..(725): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtggggggacggcgttcggtccaggcccgtggggggtcccctgagacctctcctgtgcacgtcctcgtggtactttccacctttctaagttattttaatcgtacttatgcctacgtcggggtcccgccgtacgggtcctaccggaagggggaacgggtaccgtagggtaaattagttcgttaccgttacgtaaggttaagtttaaaggtaaaaggttaaacgtacggtaaaccgtaaaattaaactaatttaattaatttaacgtacgtaacctaaaacgttcgttaggtaacgggtaaacgggtactaacgtaacgtttacccaaccctaacgtttacccgtaacccgggaaacgggtaaaccttaaaccgttaacccgaaaaacgtaacccgtaaccggttacgttacgttaacctttaccgttaacgaaacggttcgggaacctaccggaccgtaggaacggtaacgtcgtagggaaccgacgtaccgggtacttaggttaacttacgtttacggngggtaggggaacggaggggttaacggtacggttaaggttacggggaaggggtttaaccggggttggggtcccggggacgggtaaccgggg

SEQ ID NO: 267454 - DNA, 745 bp, Homo sapiens
  misc_feature: GYAE6OF01A3XMD.28.57.F02.1.454.CMB.1.raw
  modified_base (320)..(320): a, c, t, g, unknown or other
  misc_feature (320)..(320): n is a, c, g, or t
  modified_base (410)..(410): a, c, t, g, unknown or other
  misc_feature (410)..(410): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctgggtggagtcgtgggggagcgttggtccaggccgtcggggggtccctggagtactctccgtgtgcacgtcctcgtggtacttcacccttcagttatttatgactatgtcacgtcgggtcccnccgacggctccgagggaagggactaggaatatgtctgaagttatagaagtatagaacgtaaataactattaattattatgaactaaactntacggtagaagggtcaagtacgttacaacctctaccgtaccggaacgggtaaacctaaacgttacccgaaacgtaaaccaccgttactagtttacgttccctttaacggtaaacgtcggggacctaacggtacccgttagggaacgtaacgtaccggttagggaacggtaccgtaacgggtaccgtttaagttacgttaaccgtttaaacggttcggggttaagggggaacggtaaacggggtaacgggaaacgggttttaaagggtacgggttaaaccggggtttaggggggtttacggggtaccggggggtacccgggttaaacccggggggg

SEQ ID NO: 267455 - DNA, 756 bp, Homo sapiens
  misc_feature: GYAE6OF01E06W3.28.57.F02.1.454.CMB.1.raw
  modified_base (510)..(510): a, c, t, g, unknown or other
  misc_feature (510)..(510): n is a, c, g, or t
  modified_base (546)..(546): a, c, t, g, unknown or other
  misc_feature (546)..(546): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtggggggaggcttggtccagccgtcggggggtccctgacgtacctctccgtgtgcagccctcgtggtacttcctaccctttcgtacgtttaattttacgtcgtaccttagttcgaccgtaccggttcggggttacccgccgtaacgggccgtaccggaagggggaacgggtacgtaggtaacttagttgtccgtacgtaaggttatttaaggtaaagttaagttaggaaccgtaaattaaactaattaatttattaagtacgaacctaaacttcgtaggtaggaaggaccaagtactacccaactntaccgaccggtaaggaacctaacttccaaacgaacncgtctagtacttctaagaacggtcggacacgtccgaggacgtacgtcggtaacggacggtaaccggtacgtacgtttagttaaacgttacgttttacgggcggggttaaggggacgggttaaaggggaggttaaccgggttaaacggtttacggggttaaacgggttaggggggttttcggggtacgggggaaccccggtaacggggggg

SEQ ID NO: 267456 - DNA, 696 bp, Homo sapiens
  misc_feature: GYAE6OF01E1824.28.57.F02.1.454.CMB.1.raw
  modified_base (284)..(284): a, c, t, g, unknown or other
  misc_feature (284)..(284): n is a, c, g, or t
  modified_base (400)..(400): a, c, t, g, unknown or other
  misc_feature (400)..(400): n is a, c, g, or t
  modified_base (546)..(546): a, c, t, g, unknown or other
  misc_feature (546)..(546): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttgggtccagccgtggggggtccctgcgactctcctgtgcacgcctctggatcaccttcagtatttangctatgcacgtgggtcccgcaggctcgaggaaggactggaatatgtcagtaggtataagaagtaatgagaaactaaacataatattatagactaaaactcgtaggtaggaacgggnaagtacttccaaccctatcgtacccgaagggtaaacctaacttaaccaaaacgaacctacgtacgtagtaacttaccttacgaaaacgtcggggacacggtaccctagggaaggtacgacgttaggaacgggaaccgtaccgggtnttaaggttaaacgttaagttttaacggtggggttaacgggggaaggtaaacgggggaacgggtaaaccgggtaaaggtttaaacggggtaaacccgggtttaaaggggggtttcggggtaaccggggggtaccccgggtaaacggggggg

SEQ ID NO: 267457 - DNA, 728 bp, Homo sapiens
  misc_feature: GYAE6OF01A78CA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgctacgtggggtcccgccgaggcctccggaaggggaaggggactaggaatagtgtctcgtaaggtattaagaagtaatgacgaaataacattaatattatgactaaacttcgtagtagaaagggctaaggtacttaccaacccgtactccgtacccggaagggtaacctaaacgttacccaaaagaaccgtaaccgtcgtttagttactttaccgttaacgaaacggttcggggacctaacggtcccgttaagggacgggtaacgtccggttaagggaaccgggtaaccgaaccggggtaccgttagtttaaaccgtaagttttaccgggttaggggtagggggttaagggaacggggaacgggtacgggtaaacgggtttagggggtaaacggtttaagggggggttcgggttaccggggggtacccgggtaacgggggg

SEQ ID NO: 267458 - DNA, 840 bp, Homo sapiens
  misc_feature: GYAE6OF01E28NK.28.57.F02.1.454.CMB.1.raw
tcagagtacgctatcacgaccggtgctcgatttagctcgatatagttgggtctgggagaggacgcccccgcccgttcgggtttcccaggttgttctctagtttggtgatcagcactgcacacagaagagtcatgacggtagtttgggctgagcttgggttttccttgttgcttattttaaaggtgtcctagtgtgaggtgcagtctgggtggagttcgtgggggaggtcttggtccagtccggtcggggggtccctggacgactccgtccgtgtcgcgacgccttcgtggtaacttcctacctttacgtaaggtttacttttagtcgtaccttaagtcggaccgtaccggttccggggttccccggacccgaaggggtcccgttacccggaaaggggggtaaacggggtaccgttaggggtaaactttaagttcggttacctaaccggtaagggttaatttaaacggtaaaagttaagttacggaacggtaaaacttaaacgtaagtttaacttaagtttaactacggtaaacctaaaccgttcgttaggtacggtaaacgggactaaggtacttacccgaacctactaccgtacccgtaagggtaaacctaacgtaaccgaaacgtaacccgactacgttacgttaccttacgtaactaaggtcgggactaacggtctaggacgtaggtacgtagggaacgaccggacggtaccgttaggttaacttacgtttacgggtaggttaggggaacggtaggggtaacggtaacgggtttaaacgttaggggtaaacgggtttaggggtttcggggtaccgggggtccggttaaaccgggggg

SEQ ID NO: 267459 - DNA, 752 bp, Homo sapiens
  misc_feature: GYAE6OF01BPW0N.28.57.F02.1.454.CMB.1.raw
  modified_base (243)..(243): a, c, t, g, unknown or other
  misc_feature (243)..(243): n is a, c, g, or t
  modified_base (561)..(561): a, c, t, g, unknown or other
  misc_feature (561)..(561): n is a, c, g, or t
  modified_base (644)..(644): a, c, t, g, unknown or other
  misc_feature (644)..(644): n is a, c, g, or t
  modified_base (667)..(667): a, c, t, g, unknown or other
  misc_feature (667)..(667): n is a, c, g, or t
  modified_base (690)..(690): a, c, t, g, unknown or other
  misc_feature (690)..(690): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatggacggtagtttgggctgagtcgttgggttttccttgttgtacttaagtttttaaaggtgtccagtgtggaggtgcagtcgtggtggagttcggtgggggagtcgttcggtaccgnggtcccggttggggggtccctggacgtctcctccgtgtcgcacggtcctgtaggtacttcctacctttgtagtttatttagtcgtacttagtcgaccgtcggtccgggtcccgaccgacggtcctaccgggaagggaaccggtagtaggtaatacgtcgtacgtaggtaaggttaagtaagaaacgtaagtacgaaacgtaaataataattaacttacgttaagcgtaactaaacgtcgttaaggacggaaacggctaacgttacgtcaaaccgtacgtcgaaccggtaaagaaccttaacgtaacgaaaagtaaccnccggttaatacgttaaactccgtttaagaaggtccggaactaccggtcgtaaggagtaccgtacggagaaccggtctacggtnttaacgttagtaaacggttcggngggtaaacgggtaggaaccgggnggttaacggtaagggtttacggaacggggtttgggtaccggggacggggttcggaaccgggg

SEQ ID NO: 267460 - DNA, 654 bp, Homo sapiens
  misc_feature: GYAE6OF01EG0CB.28.57.F02.1.454.CMB.1.raw
  modified_base (307)..(307): a, c, t, g, unknown or other
  misc_feature (307)..(307): n is a, c, g, or t
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtcagtgtgaggtgcagctggtggagtcgtgggggagcttggtccaggccgtggggggtccctgagactctcctgtgcacgcctcgtggacttcacctttcagttattactgactatgctacgtcgggtcccnccaggcctaccggaaggggaacggactaggaatatcgtctagtacggtaattaaggaaacgtaagtagacgtaaaataacaagtaatagttaatgaactaaaactcttagtaaggaacgggtanacgtacttacaaccctaattcctaacccggaggtaaaccaacttaacgaaacgtaacacgtctagtaatccttaagaaacgttcgggactaacgcccgaagtagacgtaccgtagaacggacgacggtactagtaactacttacgtagggtaggaaggtagggacgtagggtaaaggttcggtaaaccggttaggggttcgggacggggtccggtaaacgggg

SEQ ID NO: 267461 - DNA, 665 bp, Homo sapiens
  misc_feature: GYAE6OF01B00BH.28.57.F02.1.454.CMB.1.raw
  modified_base (195)..(195): a, c, t, g, unknown or other
  misc_feature (195)..(195): n is a, c, g, or t
  modified_base (471)..(471): a, c, t, g, unknown or other
  misc_feature (471)..(471): n is a, c, g, or t
  modified_base (558)..(558): a, c, t, g, unknown or other
  misc_feature (558)..(558): n is a, c, g, or t
  modified_base (643)..(643): a, c, t, g, unknown or other
  misc_feature (643)..(643): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtcagtgtgaggtgcgngtggtggaggtcgtggggaggcgttcggtccgacgtccgtcgggggtcccgtgagacctctcctgtcgcacgccttcgtcggtattcctaccgtttactaacggtttattttaagttgtccttagttcgactacggttccgggttaccccgccgtacggccggttaccgaacggggaacgggtacgtaggtaactagtcgtctacgtaggttaatagtaagtagtacgacgtaataactaattactagttatacgtacaactcgtagaggtagganacgtatcacactcgtacgacggaactaacgtacgaacgtaacacgtacttagactttacgtaactagtggacctacgcgtagacggngtacgtggaacgcgacgtacgtagttacgttataggtagtcggggataggaggtagtaaggttaggtacggttagggttacgggngggtaccggtagggtacccggg

SEQ ID NO: 267462 - DNA, 881 bp, Homo sapiens
  misc_feature: GYAE6OF01C6K0V.28.57.F02.1.454.CMB.1.raw
  modified_base (160)..(160): a, c, t, g, unknown or other
  misc_feature (160)..(160): n is a, c, g, or t
  modified_base (190)..(190): a, c, t, g, unknown or other
  misc_feature (190)..(190): n is a, c, g, or t
  modified_base (284)..(284): a, c, t, g, unknown or other
  misc_feature (284)..(284): n is a, c, g, or t
tcagagtacgctatcacgaccggtgctcgatttagctcgatatagttgggtctgggagaggagcccccgccctgggtttcccaggtgttctcatttgggtgatcagcactggcacacagaagagtcatgacggagttgggctgagacgttggtttctgtncttaagtttaaagtcgtctagtgtgaggtncagcgtgggtagacggttcggtagggggcgtcggtttcggccacggtccgggttcggggggtcccctaggacgtacttccgtccgtggtcgacncggtcccttcgtaggtacttaccaccgttttttagaagttatttagccgtactagtcgaccgtacggtcgggtcccgaccggaaggtcccgtaccgggaaggggaacgggtaccgttaaagggtaaataacgttcgggttaccctacggttaaacggttaacgttaagggaaaacgtttaacgtacgggaaactaaaacgtaaaccgtaagttaaactttaaagttacgtacgtaaaacccttaaaacgttccggttaaaggtaacggggaaagggtaccttaaaggtaacccttacccgaaaccgtaccgttacccggtaaaaccgggaaacgggtaaaacttaaacccgtaaccggaaaaacgaacccgtaccggtacccgttaggttaacctttaaccgtaaacggtaacggtaccggggaacaacgggtacccttaagggaacggacgtacggaacggggaaccgtacggacccgttagtaagttaaagttaacgtttacggttaggggagggaacggaaagggacggttaaacggttaacgttaacggggtaaacggtttacggggtcgggtacggggaaccggtacggggg

SEQ ID NO: 267463 - DNA, 613 bp, Homo sapiens
  misc_feature: GYAE6OF01CP2V2.28.57.F02.1.454.CMB.1.raw
  modified_base (295)..(295): a, c, t, g, unknown or other
  misc_feature (295)..(295): n is a, c, g, or t
  modified_base (601)..(601): a, c, t, g, unknown or other
  misc_feature (601)..(601): n is a, c, g, or t
tcagagtacgctatcacgaccggtgctcgatttagctcgatatagttgggtctgggagaggacgccccccgccctgggtttcccaggtgttctcatttggtgatcagcactgcacacagaagagtcatgaggagtttgggctgagcttgggttttccttgttgcttaatttttaaaggtgtccagtgtgaggtgcagcgtggtggagtcgtgggggagcgttggtccagccggtggggggtccctggacgactctccgtgtgcacgcctcgtggtacttcaccttgagttattangctatcgctacgtcggcccgcgaggcctacgaaggggaaaggcgtaggtaaatcgtgtcagtaagtaagttaagaaagttaacaggaactaaaataacaattaataattactagaactaaactgtagacggaagggctaagtactacaccacttaccgacgaaggaactaactaccaaagaaccacgtcagttactacttaacaagtggacaagcctagagacgtacgagacgacgttacggatgtaaccttagtacggtaggagggaagacggtaggagttaaggtacggtaaggtagggttggngggaccgaaggg

SEQ ID NO: 267464 - DNA, 804 bp, Homo sapiens
  misc_feature: GYAE6OF01DKQZH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtctttaagtttttaaaggtgttcctagtgtggaggtgcagtcgttggtggtagtcggtgggggaggtccgttggtccgaggtccggtcgggggtccctggacgtccttcgtccgtgtcgctacgtccttcgtggtacttaccgtaccttcgtaagtttatttagtcgtcttagtccgtacgtaccgggtccgggtaccccgaccggaccggtccggtaccgggaaggggtaaccgggcgttaaggtaattacggttcgtacgtacggttaaggttaacgttaaggtaaagtaacgtagtacgtaaaactaaacgtattaattaattaagtccgtaactaaccggttaggtaggtaaacggggaacggttacgtaacgttactacccgtaaacctcgttacccggaacgtaacggtaaaccttaaccgtaccgaaaacgtaacctcgttaacgttaagttaaccttaccgtttaaacgaaggtcggaaccacggtagacgggagtcggtaagtacgggaccgtacggacgttacgttaggttaacgttcgttaagggtagggagggtaaggagggtaacgggtaaggttacgggtacggttaaagggttcgggggtagggcccgggtagggtacccggg

SEQ ID NO: 267465 - DNA, 782 bp, Homo sapiens
  misc_feature: GYAE6OF01CXO33.28.57.F02.1.454.CMB.1.raw
  modified_base (183)..(183): a, c, t, g, unknown or other
  misc_feature (183)..(183): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (210)..(210): a, c, t, g, unknown or other
  misc_feature (210)..(210): n is a, c, g, or t
  modified_base (300)..(300): a, c, t, g, unknown or other
  misc_feature (300)..(300): n is a, c, g, or t
  modified_base (696)..(696): a, c, t, g, unknown or other
  misc_feature (696)..(696): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcttgggttttccttgttgtcttaagtttttaaaggngtacagtgtgnggtncagcgtggtggngtcggtgggggagtcgttcggccaggccggtcgggggtccccagaccttctccgtgtcgacacgtcctcgtacggtacttcctacccttntaagttatttagtcgtacttagtcgcgtaccggttcgggtccccacggcggtacctaccgggaagggaacggtacgtaaggtaattacgtcgtacttacggtaaggttaagtaaggtaaacttagtacgaaccgtaaattaaactattaactttaatttacaacgaaaccttaaaccggttgttaacgggaaaggtacgggtaactaacgttacttacccgtaaccgtcctaccggtaacccgggtaaaggtaacccttaaacgtaacccgaaaataccgtacgttaccgttagtttaacctacgtttaacgaaacgggtcgaaccgtacgaccgtagaaccggttcgacgtacgggaaccggtaactcgggtactagttagtaaccgtttagggnggaacgggtaggaaccggtagggtaacgttaagggttacgggtaaacgggtggggttacgggtaccggggacgttaaggggcccgg

SEQ ID NO: 267466 - DNA, 603 bp, Homo sapiens
  misc_feature: GYAE6OF01BGX7A.28.57.F02.1.454.CMB.1.raw
  modified_base (382)..(382): a, c, t, g, unknown or other
  misc_feature (382)..(382): n is a, c, g, or t
  modified_base (497)..(497): a, c, t, g, unknown or other
  misc_feature (497)..(497): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtcccagccgtgggggggtccctgagactctcctgtgcagcctctggattccacctttcagttatttatgctatgcactgggtcccgccaggctcccgagggaagggactgggaatagtgtctcgaggtattaagaacgtaatgacgaaataacataatattangacaaactctagtaggaagggcagactccaaccatcctacgagggaaccaacttaccaaagaaccacgctagtatctacaagtgggcagcctgagagtcgagaggaccgacggtntacgttaattagttacgtgggtaggggagggtagggaacgggtacggtaaaggtttacggggaacggtttaggggggtacgggttcgggggaccggtaacgggggg

SEQ ID NO: 267467 - DNA, 675 bp, Homo sapiens
  misc_feature: GYAE6OF01B1GC0.28.57.F02.1.454.CMB.1.raw
  modified_base (410)..(410): a, c, t, g, unknown or other
  misc_feature (410)..(410): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggacttccaccttcagttatttagtgctatgctacgtcggtcccgccaggcctaccggaggggaagggctaggaatagtcgtctacgtaaggtagttaagaagtaagtgacgtaaataacattatattatgactaactctgtagaggnagtatccactatcctacgacggaactactaaccgaacgacaccgtctacgttactccttaacgaacgttgggacacggtaccgttaggaacgtaggtaccgtaggaacggaccggtaacggtccgttaagttaacgttaacgtttaacggttacggggtaggggaagggtaacggggtacgggtaaaggggttaacgttaaacgggggttaacggtttaagggggggtttcggggttaaccggggggtaccgggtaaccgggggg

SEQ ID NO: 267468 - DNA, 607 bp, Homo sapiens
  misc_feature: GYAE6OF01A7KA2.28.57.F02.1.454.CMB.1.raw
  modified_base (175)..(175): a, c, t, g, unknown or other
  misc_feature (175)..(175): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (313)..(313): a, c, t, g, unknown or other
  misc_feature (313)..(313): n is a, c, g, or t
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (385)..(385): a, c, t, g, unknown or other
  misc_feature (385)..(385): n is a, c, g, or t
  modified_base (451)..(451): a, c, t, g, unknown or other
  misc_feature (451)..(451): n is a, c, g, or t
  modified_base (546)..(546): a, c, t, g, unknown or other
  misc_feature (546)..(546): n is a, c, g, or t
  modified_base (555)..(555): a, c, t, g, unknown or other
  misc_feature (555)..(555): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgctattttaaaggngtccagtgtgaggtgcagcgtggtggagtcgtgggggagcttggtccaggccgtggggggtaccctgacgactctccgtgtgcacgtcctcgtggacttcaccttnagttacttagngctatgctacgtcgggtcccncgaggctccgagggaaggctggaatntgtctacgaggtattacgaagtaancggacaataacattatattangactaaatcgtgtagaagggcaagtcttacgacctagtccgacgaggaactaacgtccaaagaccngtctacgttaatccgtttacaaaggtccgggactacgtacctaggaagtagacctagggaaccggactacggtagttatacgtaagtttaccggngggaggganagggtcggaacgtaaggtttcgaagggttaggttgggacgggcgtaacgggg

SEQ ID NO: 267469 - DNA, 726 bp, Homo sapiens
  misc_feature: GYAE6OF01C5QFN.28.57.F02.1.454.CMB.1.raw
  modified_base (625)..(625): a, c, t, g, unknown or other
  misc_feature (625)..(625): n is a, c, g, or t
  modified_base (645)..(645): a, c, t, g, unknown or other
  misc_feature (645)..(645): n is a, c, g, or t
tcagagtacgctatcacgaccggtgctcgatttagctcgatatagttgggtctgggagaggagccccagccctgggtttcccaggtgttctcatttggtgatcagcactgcacacagaagagtcatggacggtagtttgggctgagcttgggtttttccttgttgtacttaatttttaaaggtcgttccaggtgtggaggtgcagtcgtgggtggaggtcgtgggggagtcgttgggtccacggcccggttggggggtacccctggacgtaccttcgtccgttggacgcgacgtcccttcgtaggtacttacctaaccctttctaagtttaatttactacgtacgtaattcggacctaacggttccggggtaccccgaccgtaacggccgtaccgggaaggggtaacgggacgtaggtaaattacgtcgtacgtacgtaaggtaagttaagaagttaagacgtaacgtaaaataacctattaattactaagtactaaactaaattcgtaaggtaaggaacgggtataagtactacgaactactaccgtacgtaggaactaactaaccaagtaacctacgtacttacgtacttactaagaacgtcgaacgcgttaccgaaggacgncgtaagaccggacgaggttntacgtataggttactaggggtaggtaggacggtagacggtaaaggttacggtaagggttcgggttaggggcggtaaacggg

SEQ ID NO: 267470 - DNA, 830 bp, Homo sapiens
  misc_feature: GYAE6OF01CHQKC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggaggtttgggctgagcttgggttttccttgttgcttattttaaaggtgtccagtgtgaggtgcagcgtgggtggaggtcgtgggggagtcgttggtccgagccgtggggggtccctggacgactctctgtcgcacgtcctcgtggtacttccaccttcgtagtttaatttactgtacctatacggcctacggtcgggttaccccggccgacgggtcctaccggaaggggtaaaccgggtactaggggtaaattagtcgttactacggtaaggttaattaaaggaaagttaacgtaggaaacgtaaaacttaaacctaattaaatttaagttaagttacgaaaccgttaaaccttccgttaggtaacgggaaacgggtacgtaacgtacgttaccctaaccgtaacgtccgtaaccgggaaacggtaaaccttaaccttaaacccgaaaagaaccgtaaccggtaccttaagttaaccttacttaaaccggaagttcggggaacctaacggtaccgtaacggtaagtgggaaccttcgggaaaccggtaacggtacgggtaccgttagttaaaccttaggttaaccgggtttcgggaggggtaacggtaaaggggaacccgggttaaaggggttaaccgttaaagggggttaaccggttagggggggttaccgggtaccgggggaaccgggttaacggggg

SEQ ID NO: 267471 - DNA, 865 bp, Homo sapiens
  misc_feature: GYAE6OF01CUOTN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgaggtgcagcgtggtggagtcggtgggggaggtcgttcggtccaggcccggttcggggggtccctaggacgtacctcctccgtgtcgcacgccttcgtggtactttccacctttacgtagtttattttaatcgtacttagtcgtaccgtacggttccggggtcccgtccgacggtccgtacccgggaagggggaacggtaccgtagggtaattagtcgttacgtacgtaaggttaacgttaaggtaaagtagtacggaacgtaaaacttaaactaagttaattaagtttaacgtacgtaaacctaaacgttcgttaacggtaaggaaacgggtactaaggttaacccttaacccgaaaccgttaccgttaccggtaacccgggtaagggttaaaccctaaaacgtttaaccccgaaaaggtaacccctaaccggtacgtttaacgttaaccgtttaccttaaacggtaacggtcgggtaacgtaccggtacccgagggtaacggccgttacggaacgggaacgtaccggtaacgttaccggtttaataggtttaacttacggggttacggggtaagggaggtaaacggggtacggttaacggggttaaacggtttaccggggttaaacgggtttagggggtttaccgggggacggggtacccggggttaaacccgggg

SEQ ID NO: 267472 - DNA, 697 bp, Homo sapiens
  misc_feature: GYAE6OF01DF7Y3.28.57.F02.1.454.CMB.1.raw
  modified_base (184)..(184): a, c, t, g, unknown or other
  misc_feature (184)..(184): n is a, c, g, or t
  modified_base (319)..(319): a, c, t, g, unknown or other
  misc_feature (319)..(319): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
  modified_base (683)..(683): a, c, t, g, unknown or other
  misc_feature (683)..(683): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttggggctgagcgttgggtttttccttgttgcttaagttttttaaaggngtccagtgtggaggtgcagtcgtgggtggagttcggtgggggaggtcttcgggtccaggcccggtcggggggtccctgaacgtctcctccgtgtacgcagtcctcgtggtacttccacctttcaagtttatttangtactatcgacacggtcggtcccgacgagcgtaccggagggtacggactaggaatgtcgtactagtagtaataagaaatangaacgtaaataacatttaatacttanacgaacctaattcggtagtaagggtaacgagtagtaacctaccaaccgtctacccgacgtaaccggtaacttaactaacccgaaaaggacctagtccttaagtactttaccgtaagaaaggttccggaacgcgtacggtagggaaccaggtaccgtaggggaacctacgggtcgtaaccgttaagtagttacgtttaggacggtaaggggagtcgggtaaaggtacggttaagtcgggtaacgggttgggtacgggnggggacgtacgggg

SEQ ID NO: 267473 - DNA, 861 bp, Homo sapiens
  misc_feature: GYAE6OF01CLF5C.28.57.F02.1.454.CMB.1.raw
  modified_base (202)..(202): a, c, t, g, unknown or other
  misc_feature (202)..(202): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagttgggctgagtcgttgggttttccttgttgtcttaagtttttaaaggtcgtcctagtgtgtaggtcgntagtcgtggtgggtacgtcggtgggggacgtcgttcggtaccgtacggtcccggtcggggggttccctaggacgtcctccgtccgtgtgccacgtctcgtggtacttaccgtaccttctagttattacgtcgtacgtaatcgaccgtacggttccggtacccgtacgaccggtaccgtaccggaaggggtaacggtacgtaacggtaatacgtacgttcgtacgtaggttaagttaaggaagttaacgtaggaaccaaattaacgtaattaattaagttaacgtagtaaccttaaccgtagttaacggaggtaaacggacgttaacgttacccttacccgaaccgtaaccgttaccggaaccggtaaagggttaaaccctaaacggttaaaaccccgaacggaaccgttaaccgtacgtttaacgttacctttaaccgtaacgtaaagggtcggaaccgtaacgcgttaaaggacggttccgaaggtaccggtaacgggaaccgtaccgggttagttaaaccggttaagttacccggtttaaagggttaggggagggttaaacgggtaaacgggaccggttaaggggtaaaccgtttaaccggggtttaagggtacggggtttaccgggggtaaacggggttccccgggttaaacgggg

SEQ ID NO: 267474 - DNA, 652 bp, Homo sapiens
  misc_feature: GYAE6OF01BKMBW.28.57.F02.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (541)..(541): a, c, t, g, unknown or other
  misc_feature (541)..(541): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttaaaggtgtccagtgtgaggtgcagctggtggagtcgtgggggagtcgttggtccagccgtgggggtccctgagactctcctgtgcagcctgtggattcaccttcagttatttangctagtgcacgtggtccncgaggtctcgagggaggactggaatagtgtctacgagtatagaagtatgacgtaatacatatattanacgtaacaaacgttcgtaggtaggaagggtacagtacttaccaacgtacttccgtaaccggaacgggtaaacctaacgttaaccgaaaacgaaccgtaccgtactaggttacttaccgtaacgtaaggtcgggactagtccgtagaacgtcgtacgtaggtaacggcgtaccggngttataaacgtttaagttaccggtgggtaaggggaacggtaggggacggtaacgggttaaagttacggggaaccggtttggggtaacgggtgggggaacccgtaacggggg

SEQ ID NO: 267475 - DNA, 832 bp, Homo sapiens
  misc_feature: GYAE6OF01EGTAW.28.57.F02.1.454.CMB.1.raw
  modified_base (259)..(259): a, c, t, g, unknown or other
  misc_feature (259)..(259): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggaggtcgtgggggagcttggtccagccggtgggggtccctgacgtacctctcgtgntcgacgtcctgtgtacttactaccttactaagtttactttagtcgtactagtcgaccgtacggtccggtacccgcggacggtacccgacgggacggggaacggtacgtagaattgtcgtactagtaaggttataagtaacgtatagaaacgtaaataatattaattattagaacgtaacctaaacgttcgtaggtaagggtaacggtacgtaacgttacctaaccacccttacgttaacccgtaaccgggtaaaggtaacctaaaccgtaaaccggaaaacgtaaccgtacccgtaacgttttaacgttaaccgttaaccgtttaaaggaacggggttaccgacgtaacccgggtacggtaaacgggtaacggtaacggttaccggtaaagggaaaccggtaccgggttaaccggttacgtttaagggtttaaccttaagggtttaacggggttaacgggggaacggggtagggtaaacccgggaaagggttaaacccgggttaaagggtttaaccggggaaacgggggttttagggggtacgggggttcccggggaaccgggtaaaccgggg

SEQ ID NO: 267476 - DNA, 815 bp, Homo sapiens
  misc_feature: GYAE6OF01CGV29.28.57.F02.1.454.CMB.1.raw
tcagagtacgctatcacgaccggtgctcgatttagctcgatatagttgggtcgtgggacgaggagcccccgccctgggtttcccgaggtgttctcagtttggtcgatcgacgcgactgcacacagaagagtcagtgacggtagttcggctgacgtcgttgggttttcccttgttgtccttaagtttttaaaggtcgtcctaagtgtagtaggtgcgagcgttgggtggagttcggtgggggaggtccgttcggtccgacgtccggtcgggggtccctagacgtactccgtccgttgtcgacgtcgtccctgtggtaactttcccgtaacgttacgtacgtttaacgtttacgtcgtacctagtcgtaccgtaacggttcgggtacccgcgacggtcccgtaacccgggaaggggtaacggtaccgtaaggtaatacgtccgtacgtacgtaaggttaacgtaagaacgttaagtcgaacgtaaatacgtagttaactagttactacgtactaacgttcgtaggtaaggtacggaactacgtacctacacgtacctaccgtacgaaacgggtaactaacgtaaccgtaaacgaaccgtacggtaccttaacgtaccttaacgtaaccgtaacgtacggaaccgtaccgtacgtaggaaccgttacgacgtaacggaccgtacgtaacgtcgttaacgtaagtttaccgttaaggtcgggtaaagggtaacggtaacggggaacggttaaacggttaaacgggttaacgggttaacgggttaggggttaccgggtcggggtaaccggtaacccgggg

SEQ ID NO: 267477 - DNA, 601 bp, Homo sapiens
  misc_feature: GYAE6OF01EOMMS.28.57.F02.1.454.CMB.1.raw
  modified_base (367)..(367): a, c, t, g, unknown or other
  misc_feature (367)..(367): n is a, c, g, or t
  modified_base (530)..(530): a, c, t, g, unknown or other
  misc_feature (530)..(530): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagtatttatgctatgcactcgggtcccgccgaggcctccgaggggaagggacgtggaatatgtctcgaggttattagaagtatgacgaataanattatattatgactaaactctagtagaaggcagtacttacgacctatcctacgtaaggaactaacttaccgaaacgaaccacgtacttagtactcttaacgaaagtcgggacacgcctaggacgtagtcgtagaacggacacggcgttagtattacgttacgngggtagggaagagggaggtacgggtaaagttacgggtaacgttagggggttgggtcggggcgtaacggggg

SEQ ID NO: 267478 - DNA, 736 bp, Homo sapiens
  misc_feature: GYAE6OF01A91FR.28.57.F02.1.454.CMB.1.raw
  modified_base (200)..(200): a, c, t, g, unknown or other
  misc_feature (200)..(200): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagtcgttgggttttccttgttgtctttaagttttaaaggtgtcctagtgtgaggtncgagtcgtaggtggaggtcggtgggggagtcgttcggtaccgaggtccgggttcgggggtccctagaacgtccgttccgtcccgtggtcgcgtaccgtccttgtacggtacttacctaccttacgtaatttatttagtccgtatcgtcgtccgtacggtcccgggtacccgccgtacggtccgtaccgggtaaggggtaacggtacgtaggtaagtgttacgtacgtacgttaaggtaattaaaggaaacgttagaacgtaactaaaactaactaaagttaattattaactacgtaactaacgtggtaagtaaggagtaccgtagtaaccttcaacgtacgaccgtacggaaacgtactaaaccgtaaccgaaacgacctacgtactaacgttctaacgtaactacggacgtcacgtgaacgtcgtacgcggtagaccgacgtaggtactaagtttacgtacgttggtaggtaagggacggtaggaacggttacgtaggtaaccgggtgttaggggacgggtcgggacggtaccgg

SEQ ID NO: 267479 - DNA, 800 bp, Homo sapiens
  misc_feature: GYAE6OF01ALHTQ.28.57.F02.1.454.CMB.1.raw
  modified_base (176)..(176): a, c, t, g, unknown or other
  misc_feature (176)..(176): n is a, c, g, or t
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtntccagtgtgagtgcagctggtgagtcgtgggggagcttggccagccgtgggggtccctgagactctcctgtgcagcctcgtggacttcaccttcagttacttatgctatgcacgtgggtcccnccgtaggcctaccgaggggacgggactgggaatagtgtcacgtaggtaattaaggaaataacgttagaccgtaaataaacgtaattagttaacttaatacggtaacctaaaacgttcgttaaggttaacggaaacgggggtcctaaagtacccgtttaccgaaaccccttacgttaccccgtaacccggtaaacggggtaaccttaaacggtttacccccggaaaaaggtaaacccgtaccccgggttaactttacggttaaactttacccgttaaaccgtaaaggtacccgggggtaactaccggtacccgttaagggaaacgtcggtacccggttaagggaccggtaacggaccccggggttagtacggtttaaacgtttacggttaacggtcggggttaacggggttaagggaacgggtaaacggtacggggttaaagttacccgggggttaaaggttaccggggggtttggacccgggggtcggtaaaccggggggg

SEQ ID NO: 267480 - DNA, 848 bp, Homo sapiens
  misc_feature: GYAE6OF01BBS2H.28.57.F02.1.454.CMB.1.raw
  modified_base (371)..(371): a, c, t, g, unknown or other
  misc_feature (371)..(371): n is a, c, g, or t
  modified_base (843)..(843): a, c, t, g, unknown or other
  misc_feature (843)..(843): n is a, c, g, or t
  modified_base (848)..(848): a, c, t, g, unknown or other
  misc_feature (848)..(848): n is a, c, g, or t
tcagagtacgctatcacgaccggtgctcgatttagctcgatatagttgggtttggggggtccctgagactctcctgtgcagcctctggattccaccttcagttatttatgctatgcacgtcgggtccgccaggcctaccgaagggggaagggactagggaattatcgtctacgtagggttattaaggaaagttaagtcgaacgtaaataacattaattattagtcgaactaaactcgttaggtaggaacgggctaagtacttaccaaccctagtcccgttaccggacgggtaacctaaacctttaccccaaaagaacccgtcggtacttagttacttacgtaacgaaaggtcgggacacgtccgtaggagngtacgagggacgaccgaggtactttaggttaattacgtaggtgggggtagggagagggacggtagggtaacggttagggttaaaggggttggggtacgggtaccggggacgggacgggtaccgtcccggtaggtccccgtacgtccgtcctacgaccttccccgtaacggaacccggtccggtacccttacggttccccggtttaccccgttccccggacccggtccccgtcccgttccgaccgtaccggaccggaccgaccccgtaccgtacgggactccggccaaccggccggtcccgggtcggtaccggccggttaccgggtaccggtaaccggttacccggtaaaccgttaccgttcccgtaccggttaacggttaccggttacccgtaaacggttcccggggtagtaaccgggggttcccggaagggttcccgggacgttaacccgggcggttacgtacgagggtcngtcgn

SEQ ID NO: 267481 - DNA, 784 bp, Homo sapiens
  misc_feature: GYAE6OF01BC76L.28.57.F02.1.454.CMB.1.raw
  modified_base (197)..(197): a, c, t, g, unknown or other
  misc_feature (197)..(197): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtctagtttttaaaggtgtcagtgtgaggtgcagntgggtggagtcggtgggggaggcgttggtccaggccggttcggggggtcccctggacgaccttccgtccgtggtgcacgtcctcgttggtactttcctacctttcgtaagtttaattttacgtgtacttaagttaggaaccggttcggggtcccccgccgaacgggtcccttaccgggaagggggaacgggtacgttagggtaaattacgttacgttccttacgtaaagggtttaagttaaaggtaaacgttaaagtacggtaacgtaaaaattaaacgtaaatttaattaacgtttaatacggtaacctaaacgttcgtaaggttagggaaacgggacgtaagtactttaccgaaccttacttccgtaaccgaagggaaacctaaacgtaaccgaaacgtaacgtacctcgttacgtaactttccttaagaacggtcggacgtcgtaccgaaggacgacggtcgtaggaaccgggtactacggtacgttagttatttagtacgggtaggtggggaaggaggggtaaggaacgttagggttacgggtaacggtttggggtagggttcgggaacgggtacggggtccg

SEQ ID NO: 267482 - DNA, 757 bp, Homo sapiens
  misc_feature: GYAE6OF01BA5H2.28.57.F02.1.454.CMB.1.raw
  modified_base (415)..(415): a, c, t, g, unknown or other
  misc_feature (415)..(415): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtctgggttttccttgttgctatttttaaaggtgtccagtgtgaggtgcaggctggtggagtcgtgggggagtcgttggtccagccgtgggggggtccctgagactctcctgtgcagcctctggattcaccttcagttactttagtgctatgcacgtgggtcccgccaggtcctaccggaggggtaacgggctaggaatagtcgtcttacgaggttatttaaggaaagttaagtgacggtaaattaactaatataattatgactaaaacttntacggtaggaagggctaagtacttaccgaacctaacgttaccgtacgtacggggtaactaaccgtttaccgaaaacggtaaccacggtaaccgttaggtaacctttacgttacgtaaaagtgggtaccgtaaacggtccccgttaggaacgggtacggtacgttacgggaacgggtaccgtacggggtaccgttacgggttaacttaagttttaaccgggtttacgggtacgggggaagggttaagggggaaacggtaggggttaaaacggttaacgggggttaaaccgggtttaagggggggtttcgggttaaccgggggggtaccggtaaacccgggggg

SEQ ID NO: 267483 - DNA, 969 bp, Homo sapiens
  misc_feature: GYAE6OF01CH86H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttaagtttttaaaggtgtccagtgtgaggtgcagtcgtggtggagtcggtgggggagtcgttggtaccgacggtccggttcggggggtccctaggacggtaccttccgtccgttggtcgccgacgtccgttcgtacggtacttacccgtacctttacgtaagtttaatttacgtcgtaccgttagtacgtaccgtaccggtcgggtacccgtaccgtacgggtcccgtaccgggaaagggggtaacgggtaccgtaagggtaacttacggttacggttacgttaacggtaaggttaacgttaaaggtaaacgttaacggtacgtaaacgttaaaacttaaacgtaagttaaactttaagtttaacgtacgtaaacgtaaaccgttcggttaacggtaacggtaacgggtactaacggttaacttaccccgaacccttaggtccccgtaaaccgggtaaaggtaaacccttaaacgttaaacccggaaacggttacccgtaaccgtttacgttaaccggtttaactttaccggttaaacggaaaccggttccggggtaacctaccggttaaccggtggtaaaccggtacggtacccgggttaaagggtacccccgggtaaccgggttaccgttacggttttaaagtttaaaccgttaacggttacgggggttaccggggttaaaggggaaaccgggtaacggggtacccggtttaaagggtttaaccgggtttaaacggggggttaacggggttttaccgggggtacccggggggtaaacccggggtacccggggtacccggggg

SEQ ID NO: 267484 - DNA, 702 bp, Homo sapiens
  misc_feature: GYAE6OF01EMRR6.28.57.F02.1.454.CMB.1.raw
  modified_base (277)..(277): a, c, t, g, unknown or other
  misc_feature (277)..(277): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcacgcctcgtggattctaccttntagttatttatgctatgctacgtcgggtcccgccgacgggcctaccggaaggggaacgggacgtaggaattagttcgtctacgtaggttaattaaggaaagttaagtggacgtaaataactaattaattattaagtgactaaacttcgtaggtagaacgggtcagtacttaccaacctactacgtaccgaaggaactaacttacccgaaagaaccgacgtcttacttacgttccttaacgtaagtcgggacacggtaccgtaggaacggtacgtccgtaggaaccgggaccgacgggtaccgttagttaacgttacgtttacggtagggttagggggaaggtacgggaacgggttaacgggtaaagggtttacgggtaaacgggttttcgggggttacggggttacggggccgggtaaacggggg

SEQ ID NO: 267485 - DNA, 650 bp, Homo sapiens
  misc_feature: GYAE6OF01BE5VM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagccgtggggggtccctgagactctcctgtgcagcctcgtggattcaccttcagttatttatgctatgcacgtgggtcccgccgaggcctccggaggggaaggggactaggaatatgtctacgaggttaattagaagtaagtgacgaaataacatattaattatacgactaaactcgtagtagaagggcaagtacttaccaaccgattacctaccgaacgggaactaaccgttacccgaaagaaccacggtcttaggttactctttaacgaaattcggggacctaggtccgtaggaagggtacgacgttaggaaccgggacacccgggtattaggtaatttacgttacgtagggttgggaaggtaggggaggaccgggttaaggttagggaaccggtttaggggttcggtgggggcccgtaaggggg

SEQ ID NO: 267486 - DNA, 767 bp, Homo sapiens
  misc_feature: GYAE6OF01BOVMA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagtcgttggtccgagccggtcgggggtccctgacgtacctctcctgtgacgacgtccttcgtggtacttcctacctttcgtaagtttatttagtgcttacgtgacctacggtcgggtcccgccgaacggtccgtacccggaaggggtaacggtacgtaggaattagtcgtcgtacgtaaggttaagttaaggaagttaagtagtaacgtaaaataactaattaattaagttagtacgaacttaaacgtgtaggtaggtaacggagtaagttacttaccgacttaacgtacccgtaacgaaggtaaacctaacttaaaccaaacggtaacctaccggttacttacgttacttaccttaacgtaacgggtcgacctaacggtccgtaggaaggtacgtacggtacggaaccggtcgtaccggggtactaacggtttaattaaggtttaccgggtggggttaaacggggaggtaaacgggtaaacggtaacgggttaacggttaacggggtaacgggttttcgggtaagggtacccgggggtcggtaaaccggggg

SEQ ID NO: 267487 - DNA, 743 bp, Homo sapiens
  misc_feature: GYAE6OF01C50WQ.28.57.F02.1.454.CMB.1.raw
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgacgaatacatatattatgacaaactctgtgaagggcagattcaccatctaccgaggacatccaagacacgctgtatcttacaaagtgggcacgccgtaggagagcgtaggacggaccgacggtctagtaatattacgtggtagggaggaggaggacggtaagtacgggtaacgtaggggttcgggtggggaccgtaggggaccggtccgtgggtccgtaccgtccttcccgcgaccgtccctacccgaaccgtaccgggcccctacggtccccggttccttaccccccggccggtaccccgtccccgtaccgtcccgtacccggacgggaccgacccgacccgtaccggaacggtaccgaccgtaccggaaccgggtcccgggtacccggtcgggtccgtaccggtcccggttaccgggtaaccggaaccggttacccgttaacccgttacccgaacgttaccgggtacccgtaaccggttccgggttacggccggggtacccggggtcccggttacgggggacccggtaaacgggccgggtaaccgaacgttacgggacgcgtgtacg

SEQ ID NO: 267488 - DNA, 630 bp, Homo sapiens
  misc_feature: GYAE6OF01BQPM1.28.57.F02.1.454.CMB.1.raw
  modified_base (310)..(310): a, c, t, g, unknown or other
  misc_feature (310)..(310): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtggggggaggcttgggtccagccgtgggggggtccctgagactctcctgtgcagcctctggattccaccttcagttatttatgctatgcacgtggggtcccnccgacggcctaccgaggggaacgggactagggaatagtgtacgtacgtaggttaattaagaagttaaatggaacgaaataaacaattaataattaatgaactaaactctggtaggaagggacagtaactccaacctactcctaccgaaggaacctaacttaccaaagaacacgtctagtactctacaagtcgggcagcctagagacgaccgtggaacggaccgacgtagtagttaagtacgttagtagggtaggggagacgggaaggtacgggtaaagttgggaacgtttaaggggtgggtacgggggccgtaacggggg

SEQ ID NO: 267489 - DNA, 660 bp, Homo sapiens
  misc_feature: GYAE6OF01CDENX.28.57.F02.1.454.CMB.1.raw
  modified_base (390)..(390): a, c, t, g, unknown or other
  misc_feature (390)..(390): n is a, c, g, or t
  modified_base (540)..(540): a, c, t, g, unknown or other
  misc_feature (540)..(540): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtcggggggtccctgagactctcctgtgcagcctcgtggattcaccttcagttatttatgcttatgctacgtcggtccgccagggcctccgaggggaacgggactaggaatagtgtctacgtaggttattaagtaagtaatgacgaataacattaatacttanacgtacaaacgtctggtaggaacgggctaagtacttaccaacctactaccgttacgaaggtaactaacttaccgaaagaccgtacgtcttagtacttcttaacgaagttcgggcacggcgttaggacggtagacgtagggacggacccgnggtccttagttaactacgtttaccgggtagggttgggggaacggaaggggtacggtaaccggggttaagttacggggaacggttttaagggggtcggtacggggggcccgtaacgggggg

SEQ ID NO: 267490 - DNA, 871 bp, Homo sapiens
  misc_feature: GYAE6OF01CE5CZ.28.57.F02.1.454.CMB.1.raw
  modified_base (92)..(92): a, c, t, g, unknown or other
  misc_feature (92)..(92): n is a, c, g, or t
  modified_base (232)..(232): a, c, t, g, unknown or other
  misc_feature (232)..(232): n is a, c, g, or t
  modified_base (337)..(337): a, c, t, g, unknown or other
  misc_feature (337)..(337): n is a, c, g, or t
tcagagtacgctatcacgaccggtgctcgatttagctcgatatagttgggtctgggagaggagcccccgccctgggtttcccaggtgttctnatttggtgatcagcactgcacacagaagagtcatgacggtaggtttgggctgagtcgtttgggtttttccttgttgtctttaagtttttaaaggtgtcctagtgtgaggtgcgagtcgtggtggaggttcgggtgggggnggtcgtttcggtccgacggtcccgggttcggggggtccctggacgtcttcctccgtgtcgccgacgtccgttcgtggtacttcctacctttcgtaagtttatttntcgtacttagtcgtcgtaccggtccgggtcccgaccggtacggtcccgtacgggaacgggggtaacggtacgtaggttaatacgttcgttacgtaacgttaaggttaacgtttaaaggtaaacgttaagtacggtaaaccgttaaaataacttaaatttaagtttaaacgtttaacgtaaccttaaacgtaaaccgtttagtaagggttaacggaacggtacgtaacgttacccttaacccacgttaccgtacgtaaacccgggtaaacggtaaacctaaaccgtaaaccggaaacgtaacccgtcggtttaactttacggtttaaaccttaccgggtttaaacgaacgggttaccgggtacgtaaccggtacgtaacgggtagtaccggacgtaacgggaacgtacggtacgtaagttagttaagttacggttaggtggggtaaggacgggtacggtaacgggttaagggttaacggtttacggggttaggggttaaccggggttcggggaccgggggttcggtaaaccgggg

SEQ ID NO: 267491 - DNA, 869 bp, Homo sapiens
  misc_feature: GYAE6OF01C2I3Q.28.57.F02.1.454.CMB.1.raw
  modified_base (184)..(184): a, c, t, g, unknown or other
  misc_feature (184)..(184): n is a, c, g, or t
  modified_base (564)..(564): a, c, t, g, unknown or other
  misc_feature (564)..(564): n is a, c, g, or t
  modified_base (849)..(849): a, c, t, g, unknown or other
  misc_feature (849)..(849): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcgtggttttcgtgttgctattttaaaggtgtcagtgtgnggtgcagctggtggaggtcgtgggggaggcttcggtccgacggtccggttcgggggggttcccctaggacgaccttccgtccgtgtcgcacgtccttcgtaggtactttccctaacctttcgtaagtttatttagttcgtaccgttagtcgcgtaccggttccggggttcccgaccggaacgggtcctacccgggaaagggggaaacgggtaccgttaagggtaaatttagttaccgttaccgttacggttaaggtttaacgtttaaagtaaaacggttaaattacggaaaaccgttaaaaattaaacctaagttttaaactttaagttaacgtaccgtaaccttaaacccgttaggtacggttaacgggtaaaccgggntaacggttaaccttacccgtaaccctaaccgttaccggtaacccggtaaacgggtaaaccttaaacgttaacccgaaacggtaaacccacgttaccgttaacttacgttaccttaacgtaacggttaccgggctacggacgtacggtacgtaggtaccgtagtaaccgggtacgtaaccgtacggttaagttaaccttaggtttccgggttaagggtaggggaacggtagggaaacccgggtggttaaacggttacggggttaaacggttgggggtttaccgggnggggttaacccgggaccggg

SEQ ID NO: 267492 - DNA, 811 bp, Homo sapiens
  misc_feature: GYAE6OF01CTNC2.28.57.F02.1.454.CMB.1.raw
  modified_base (749)..(749): a, c, t, g, unknown or other
  misc_feature (749)..(749): n is a, c, g, or t
  modified_base (796)..(796): a, c, t, g, unknown or other
  misc_feature (796)..(796): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttggggtttttccttgttgtcttaagtttttaaaggtgtcctaggtgtggaggtgcagtcgtgggtgggagtcggtgggggaggtcttcggtccaggtcccggtggggggtccctggacgctctcctgtcgcagtcctcgtggactttccaccttcgtaagtttaatttatcgtctagtcggaccgtcggttccggggtcccgaccggtaccgggtccgtacccggggaaaggggggtaaacgggtaccgtaaggggtaaacttagttcggttacccgtaacggttaagggttaaaagttaagggtaaaacttaacggttaggtaaaccggtaaaaagttaaactaaattaatttaaactttagtaacgtaacctaaacgttcgtagggtagggaaacgggactaagtaccttaccaccgtacgttaccgtaaccgggaaacgggtaaaccttaaactaacccggaaactaaccggtacgtaccgttaaggttacttacttaaacgaacggtcgggacgtacgacccggtagtaacgggcgtaggtacggaacgggactacggtcttagtaacgttagtacggttgggaaggggtaaggngggacggtaaggttaagggtacgggttaaggttggggttaaccgggngggtaccggacgggg

SEQ ID NO: 267493 - DNA, 754 bp, Homo sapiens
  misc_feature: GYAE6OF01DFHNF.28.57.F02.1.454.CMB.1.raw
  modified_base (207)..(207): a, c, t, g, unknown or other
  misc_feature (207)..(207): n is a, c, g, or t
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgcttatttttaaaggtgtccagtgtgagtgcagctggtggagtcgngggggaggtcgttggtccagccgtggggggtccctgagctctcctgtgcacgcctgtagacttccaaccttcagtttatttagtgtctatcgctacgtcggggtcccnccgaggcctaccggaaggggaacggacgtaggtaactagtcgttctacgtaaggttaagttaaggaaagttagtacggaacgtaaaattaaactaagtttaatttaaatttagtaacgtaactaaacgtttcgttaagggtaaggtaacgggacctaagtacttaccgacctactacgtaccgaacgggtaacctaaacgttaaccaacgtaaccgtaccgtacttacgtaacttacgttaacgtaaacgtcgggtacgacggtaccgtaggaacgtacggtacgtaacgggacggaaccgtacggtaccgttagttaacgttacgttaccggttagggtaagggtaaggtaacggggtaagggtaccggttaaagggttacgggttaaacggggttagggggttacggggtacggggggtaacccgggtaaccggggg

SEQ ID NO: 267494 - DNA, 730 bp, Homo sapiens
  misc_feature: GYAE6OF01DFEF8.28.57.F02.1.454.CMB.1.raw
  modified_base (227)..(227): a, c, t, g, unknown or other
  misc_feature (227)..(227): n is a, c, g, or t
  modified_base (357)..(357): a, c, t, g, unknown or other
  misc_feature (357)..(357): n is a, c, g, or t
  modified_base (447)..(447): a, c, t, g, unknown or other
  misc_feature (447)..(447): n is a, c, g, or t
  modified_base (521)..(521): a, c, t, g, unknown or other
  misc_feature (521)..(521): n is a, c, g, or t
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggacgcccccgccctgggtttcccaggtgttctctatttggtgatcagcactgcacacagaagagtcatgacggtagtttgggctgagtcgttgggttttccttgttgtacttaatttttaaaggtcgtccagtggtgaggtgcagctggtggtagtcggtagggggngtcgttggtcccgaggtcccggtggggggttccctaggacgtaccgttcctccgtgtcgcacggtccttcgtaggtacttcctaacctttcaggtttaatttacgtcgtctatcgctacgtcgggtcccnccgagccgtaccggaagggaaggtacgaggtactagtcgtctagtaagtagtagaagtatgaacgtaaataaactagttaactttaagtntacgtaaactaccgttgtaggtagaacggtagttaacgtacgttaccaccgtactttccgtacgaacggttaanaaacccgttanaaacgtaccgacgtcttacgtaattaccgttaagaaggtacggtactaacgtaccgtaggtaagcgtagggtcgaaccgtcggtaaccgttacgttaagttacgttaacgtacggttggggaagttaacggggcgtaacggtaacgggtaaggttacgggaaacgggtttggggacggtaacggggtacgtacggggg

SEQ ID NO: 267495 - DNA, 748 bp, Homo sapiens
  misc_feature: GYAE6OF01CAK5J.28.57.F02.1.454.CMB.1.raw
  modified_base (193)..(193): a, c, t, g, unknown or other
  misc_feature (193)..(193): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttggttttccttgttgcttatttttaaaggtgtccagtgtggaggtncagctgggtggagtcgtgggggagcgttggtccagcggtgggggtccctgagactctcctgtgcagcctcgtggtacttcctacttcgtagttattatgctagtgctacgtcggtccgccgaggtccgtaccggaaggggaacggtacgtggtaattcgtcgttccgtagtaacggttaattaacggtaaagtagtacggaacgtaaaattaactattaagtttacttaacgtactaacgtaaactcgtaaggtacgggaaacggtacttaaggtacctttacccgaacctggttaaccctaccgggacgtaaacttaaccgtacgaaaacgaaccgtcgtaacttacggtaacttaccgttaacgaacggtcggaacctcggtaccctaggaccgggtagtaaccgtagggaaccgtaccgtcggtattacggtttaaacgtaccgtttagggttaccggggtagggtaacgggttacgggaacggtaaacgggttaagggttacggtaacggggtttaggggtccggggtaacggggcccgggttaaacgggg

SEQ ID NO: 267496 - DNA, 772 bp, Homo sapiens
  misc_feature: GYAE6OF01CI5FH.28.57.F02.1.454.CMB.1.raw
tcagagtacgctatcacgaccggtgctcgatttagctcgatatagttgggtctgggagaggagcccccgccctgggtttcccaggtgttctcatttggtagatcagcactgcacacagaagagtcatgacggtagtttgggctgagtcgttgggttttccttgttgtcttaagtttttaaaggtcgtcctaggtgtaggtaggtgcgacgtcgtgggtggaggtcgtggggggacgtcgttggtcccaggtccggtcggggggtccctggacgactccgtccgtgtcggacacgtccgttcgtggtacttccgtaaccctttgtagttatttagtcgtacctagtacgccgtacggttcgggaccccgacgacggccgtaccggaaggggacggtacgtaggtaatacgttcgtactacgtaaggttaagtttaacgaagtttaagacggaaccgtaaagtaactaattaatatttaggtacgaacttaaacctcggtaggtaagaaggacctacgtaacttaccaaccgtactcccgtaaccgaacggtaaacctaacgtaaccaaaggtaacccgtaaccgttcgtaacgttaacgttaccttaagaaacggtcgggacacggtaccgttgaacggtcgacgtaacgggacgtaccggtacggtactacgtaagttaaccgttacgggtacggtagggacgtagggaggtacccggttaaagggttcggtaaacgggttcggggtaacggttcggggaaccggtacgggg

SEQ ID NO: 267497 - DNA, 603 bp, Homo sapiens
  misc_feature: GYAE6OF01BJXIG.28.57.F02.1.454.CMB.1.raw
  modified_base (487)..(487): a, c, t, g, unknown or other
  misc_feature (487)..(487): n is a, c, g, or t
  modified_base (500)..(500): a, c, t, g, unknown or other
  misc_feature (500)..(500): n is a, c, g, or t
  modified_base (514)..(514): a, c, t, g, unknown or other
  misc_feature (514)..(514): n is a, c, g, or t
  modified_base (540)..(540): a, c, t, g, unknown or other
  misc_feature (540)..(540): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggagtcttgggtccagccgtggggggtccctgacgtactctcctgtgcagcctctggacttcacctttcagttatttatgctatgcacgtcgggtccgccgaggcctaccgagggaagggtactaggtaatagtgtctcgaaggtattaaggaagtaatgacgaaataacataatattatgactaaactcgtgtagaagggactagtacttacaccacttccaccgacgggtaacaacttaccaagaacacgtactgtactactacaagtggacngaccgtgacgagngagaggacacggtntagtattagttacgtggtgggaaggnggtaacggcgggtaaagttacgggtaacgggttagggttacggggtcggggcgggtaacgggg

SEQ ID NO: 267498 - DNA, 788 bp, Homo sapiens
  misc_feature: GYAE6OF01BYUN3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgtcttaatttttaaaggtgtccagtgtgaggtgcagcgtggtggagtcgtgggggagcgttggtccgaggccggtcggggggtccctgacgtactccgtcctgtcgcagcctgtcggtacttcaaccgttctaagttatttagtgtacttagtcgtctacggttccgggtcccgccgacggtccgtacccggaaggggtaacgggtacgtaaggtaacgttaagttcgttacgtaccggtaaggtttaacgttaaaggtaaagttaagtaggaaacgtaaactaaactaattaagttaattaacgtacgtaactaaacgttacggtaggtaaggtaacgggactaagttactaccctaaccgtctacccgtacggtacggaaacttaacgtaaccgaaacgacctacggtactacgttaacgttacttaacgtaaggtcgggtacctaacgtccgtagggaacgtacgtaggtacggaacggtaccggtaaccggttcgttaaggttaacgttaggttttaccggtaggggttaagggtaagggtaacggggaggtaacgggttaaacggttaacgggggtaacggtttagggggtcgggtaccgggggtccgggtaaaccggggg

SEQ ID NO: 267499 - DNA, 881 bp, Homo sapiens
  misc_feature: GYAE6OF01BB230.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggtcttggtccagccgtgggggtccctgagactctccgtgtgcgacgcctcgtggtacttctaccttcagttatttactgtctatcgctacgtcggtcccgacgacggcctaccggaggggaacggtacgtaggacttagttcgtactacgtaaggttaagttaacggtaaggttaagtacggaagtaaaacttaaacgtaagttaatttaacgtttaagtacggtaaaccttaaacgttacgttagggtaacgggtaacggggtaccgtaacggtttaaaccttacccgtaaacccgtaaccgtttaccgttaaaccccgggaaacgggtaaaaccctttaacgttaaaaccccgaaaggtaaaccccgtaccgggttacctttaacggttaacctttaaccggttaaacgttaaagggtaccggggtaccctaaaccgggtacccgttaagggtaagggtaaccgggttacgttaaacgggggaaccgtaaccgggaccggtacgggtttaaacggttaacttttaacgggttaacgggttcgggttaaaggggggaaccggttaagggggaccgggtaaaccgggggtttaaggttaccgggggttaaaacgggttaccgggggggttttacgggtaccggggggtcccgggttaaacccgggggg

SEQ ID NO: 267500 - DNA, 752 bp, Homo sapiens
  misc_feature: GYAE6OF01EEC4H.28.57.F02.1.454.CMB.1.raw
  modified_base (284)..(284): a, c, t, g, unknown or other
  misc_feature (284)..(284): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgacgactctcctgtgcagcctctggattccaccttcagtatttangtctatgctacgtcgggtccgccacggtcctaccggaaggggaacgggtacgtagggaattagtcgtcgtacgtaggttaattaaggtaaagtaacgttagacgtaaaagtaaactaattaatttaattaagtcgtaactaaaaccctgttaaggtaacgggaaacgggtactaaggtaacttacccaacctaacgttaccgtacccgaagggtaaacctaaacgtttaacccgaaacgtaacccgtaacgtacctttaagttactttaacccttaagtaaaacggttcgggaactaccggtaccgtaggaagtacggtaccgtagggacggaacgaccgggtcttaagggttaacttaacggtttacgtacgggtaggggaaaggtagggaacggttaacggggtaaaggtttacgggtaaacgggtttagggggttacgggttaccgggggaccggtaaccggggg

SEQ ID NO: 267501 - DNA, 570 bp, Homo sapiens
  misc_feature: GYAE6OF01DBAXU.28.57.F02.1.454.CMB.1.raw
  modified_base (174)..(174): a, c, t, g, unknown or other
  misc_feature (174)..(174): n is a, c, g, or t
  modified_base (258)..(258): a, c, t, g, unknown or other
  misc_feature (258)..(258): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaaggngtccagtgtgaggtgcagctggtggatcgtgggggagctggtccagccgtggggggtccctgagactctcctgtgcagcctcgnggattcaccttcgagttatttangcctatgacngtcggtaccgccaggcctccgagggaaggctaggatatgtcngagtatagaagtatgacaataacatatatangaccaatngtagaggcagactcacatctacgaggactaactacaacgacacgtcttagacttacctaacgagtcgggactacgaccgtagacgagcgtaggacggacacggtcttaagtatacttacggtaggtagggaaggcgggtaggtaacggtaagtttacgggaaacggttgggggtacggtcgggtaccggtaacggggg

SEQ ID NO: 267502 - DNA, 633 bp, Homo sapiens
  misc_feature: GYAE6OF01BL2ZM.28.57.F02.1.454.CMB.1.raw
  modified_base (292)..(292): a, c, t, g, unknown or other
  misc_feature (292)..(292): n is a, c, g, or t
  modified_base (352)..(352): a, c, t, g, unknown or other
  misc_feature (352)..(352): n is a, c, g, or t
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttaatttttaaaggtgtccagtgtgaggtgcagctggtggagtcgtggggggagtcgttggtccaggccgtggggggtccctgagactcgtcctgtgcagcctgtggacttcaccttcagttatttngctagtgcacgtcgggtcccacgaggcctacggaaggggaacggctaggaatagtgttcncgtaggttaataagtaactaagtgacgaaattaanattaatattaacgtgaactaaactcgtggtaaggaaaggctagtacgtaccactacgtactaccgaaggacaacgttaccaaagaacacgtctagtactactaacgtaagtggtaacgacgtacgtagacgagtacgaggtaacggacgtacggtcgttagttaataagttacggtagggtagggaaggagggtacgggtaaggagttacggtaacggttagggtttcggacggggcgtaacgggg

SEQ ID NO: 267503 - DNA, 827 bp, Homo sapiens
  misc_feature: GYAE6OF01CW0JU.28.57.F02.1.454.CMB.1.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctctatttggtgatcagcactgcacacaagaagagtcatgacggtagtttgggctgagtcgttgggttttccttgttgtcttaatttttaaaggtgtccagtgtgaggtgcagngtggtggagtcggtgggggagtcgttggccngccggtgggggtcctagagctctctgtgcacgctctggtacttccaccttntaagttaatttacgtctntagtcgcgtaccggtcgggtcccgaccgtagcccgtaccgaaggggacgtacgtaggtaatatgtaccgtcgtaaggttaattaagaaacgttaanagtaaacgaaaacttaaactaagttaaacgtattaagtacgtaaactaaacgtgttaaggtacggaaaggtaccagtactacaacctacgtacctaacgaacggaacctaaagtaaccctaaaacgaacctaaccgtataacgttacctaacgttaaaccgtaaggtacggggtacctaacggtaccgttaacggaacgtaacggtaccgggttacgggtaaaccggaaccggttaaccgggtaacgttaaggtttaaaccgtttaaaggttaaccgggttaacggggggtaaggggtaaaacgggggtaagggtaaaccgggggttaacggggttaaaacgggttaaacgggggtttaaacggggttaaacgggggggtttaccgggggtaaaccgggggggtaccggggttaaaacccccgggggg

SEQ ID NO: 267504 - DNA, 940 bp, Homo sapiens
  misc_feature: GYAE6OF01EC97L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtacttagtttttaaaggtcgtccaggtgtgaggtgcaggtcgttgggtgggacggttcggtggggggtacgtccgttcggtcccgacggtcccggttcggggggttccctaggacgtaccttccgtccgtgtcgcctacgtccctcggtacgtactttccctaacctttcgtaagtttacttttagcgtacttagtacggtaacggttccggggtaccccgtccgtacgggtcccgtacccggggaacggggggtaaacggtaccggtaaggtaaacgttagttccgttaaccgttaacgggttaaaggtttaaagttaaacggtaaagttaaacgtaggtaaaccgtaaaacttaaacgtaatttaacttagtttacgaacgtaacctaaacgttcgttaagttaagggaacgggtacttaaggttaaccttacccgaacccgtacttaaccccgttacccggaaacgggtaaacttaaacccgtacccggtaaaaggtaacccctaacgggttccgtttaaccgtttaccgtttaaccttaaggttaacccggtacgggtacctaccggtacgtaggtaacgacgggtaccgagggttaaacggacccgtagggtactttaaggttaatttaaggtaccgggttaacggggtagggtaacgggtaaacggggttaaacgggtacggttaaaacgggggtttaccggggttaacgggttacggggggtttacccgggtaacggggtacccggggttaaccgggtaacccccggg

SEQ ID NO: 267505 - DNA, 836 bp, Homo sapiens
  misc_feature: GYAE6OF01CNYTE.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagcgttgggttttccttgttgtcttaagttttttaaaggtgtcctagtgtgaggtgcagcgtgggtggagtcggtgggggagtcgttggtccaggccggttcggggggtccctggaacgtcttcgtccgtgtcgcgacgccttcgtggtacttcctaccttactaagtttatttatcgtactacgtcggccgtacggttccgggggtcccaccggtaccgggtcccgtaccgggtaaacgggggaaacgggtacgttaaggggtaaattacggttacgtttacccgtaaggttaaagggtttaagttaaaaggtaaaacgttaaagtcggtaaacgtaaaacgtttaaactaaagtttaattaagtttactacgtaaaccgtaaacttcggtaggttaaggaacggtctaagtaactttacccaacccgttcgttacccgtaaccggaaacggtaaccttaaaccgttaaacccgaaacgtaaccgtaaccgttcgttaacggttaacttaccgttaaacgaacggttccgggaactacggtaccgtaggacgtacgtacgtaggaacggtacgtaacggtcttaagtaaacttggtaacggtgggtagggtaacggaacgggtacggtaacggttaaggtttaacggggtaacggtttagggggttacgggaccggggtcggtaaccgggg

SEQ ID NO: 267506 - DNA, 676 bp, Homo sapiens
  misc_feature: GYAE6OF01EC300.28.57.F02.1.454.CMB.1.raw
  modified_base (211)..(211): a, c, t, g, unknown or other
  misc_feature (211)..(211): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
  modified_base (664)..(664): a, c, t, g, unknown or other
  misc_feature (664)..(664): n is a, c, g, or t
tcagagtacgctatcacgaccggtgctcgatttagctcgatatagttgggtcgtgggagaggacgcccccgccctgggtttcccaggtgttctcatttggtgactcagcactgcacaccagaagacgtcagtcgacggtagtttcgggctgagtcgttgggttttccttgttgtacttaagttttaaaggtcgtcctagtgtagacggtcncgagtcgtggtggagtcggtgggggtagtccgttcggccaggtcccggtcgggggttcccaggacgtacctcctccgtgtcgacctacgtccttagtacgtacttccaaccttacgtaagttacttttagcgtacctagtcgaccgtacgtcggtcccgcgacgtccgtacggtaagggacgtacgtaggtaatacgtcgttaccacgttaagtagttaacggtaatagtacgaacttaaagtaactataattacttaagactaactaacgtcgtagtaggacgtcattacncctacgtancgtacgaagtactacaacgtaacactacgtagtatacgttactaagtaagtcggactaggactaggaacgtacgtagtacggaaccgacgtcgtattagtagtacgttcggagtggagtaggtacgtagtaggtacgtagggtgttacgggnggtcgtaccggg

SEQ ID NO: 267507 - DNA, 737 bp, Homo sapiens
  misc_feature: GYAE6OF01AVR7E.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttcttgttgctattttaaaggtgtccagtgtgaggtgcagctggtggagtcgtgggggagcgttggtccagccgtggggggtccctgagactctcctgtgcagccttctggacttcacctttcagttatttatgctatgcacgtcggtccnccgaggctccgaggggaaggctaggaattagtcgtctacgaggttaattaggaacgttaagtggtacgaaattaaactattaattaagtttatacgtaactaaacgttctaggttacggaacggggtactaaggttacttcccaaaccgttacttaccccgttacggaaccggggtaaacttaaacccggttaaccgaaaaccggtaacctaacgtccttaagtttaacctttctttaaacgaaagttccgggctaaacggtcccgttaaggacgttaacggctaacggggtaacggtaccgaacggtcttaaggttactttaggttaaccggttcggggtaagggttaacggaacggggtagtaacccgggttaggttaacgggtaacggtttaacggggggtttcgggtaccggggtcccggggtaaaccggggg

SEQ ID NO: 267508 - DNA, 833 bp, Homo sapiens
  misc_feature: GYAE6OF01DPWQJ.28.57.F02.1.454.CMB.1.raw
  modified_base (148)..(148): a, c, t, g, unknown or other
  misc_feature (148)..(148): n is a, c, g, or t
  modified_base (187)..(187): a, c, t, g, unknown or other
  misc_feature (187)..(187): n is a, c, g, or t
tcagagtacgctatcacgaccggtgctcgatttagctcgatatagttgggtctgggagaggacgcccccgccctgggtttcccaggtgttctctatttggtgatcagcacctgcacacagaagagtcagtgacggtgtttgggctagngtcgttgggttttccttgttgtctttaagttttaaggtntaccgtaggtgtggaggtgccgagtcgttgggtaggtggttcgggtggggtcggtcgttcgggtccgacggtccgggttccgggggtccctaggacgtccttccgtcgtgtcgcaccgtcgtcgtacgtactcctaccttcgtagtttacttagtcgacttagtaccggtcgtaccggttccggggtccccgaccgggtaccgtcccgggaccgggtaaacggggtaacggtacgtaaaggttacgtacgttcgttaacgtaggtaagtaagttaacgtaagtaagtacaacgtaaaagtactaacgttattaacgtataacgtaactaacgttggaaggtaccggaaggtactaacgttacctacggtacctacgttaccgtacggtaacgtaaaccgtaaccgtaacgaacgaacggttccgtaagttaccgttaacttaaccggttaacgtaaagggtccggtaacgcggttaaccgtggaaccggttacgaacggtaagacccgggtaacgtaggttaccgtagttaaaccgttagggtaacgggttacgggtaaggggttaggaacggggttcgggttaaaaggttcgggttaaagggttacggtcggggttaacggggtccgggtaccgggtacccgggg

SEQ ID NO: 267509 - DNA, 794 bp, Homo sapiens
  misc_feature: GYAE6OF01BHJ2M.28.57.F02.1.454.CMB.1.raw
  modified_base (180)..(180): a, c, t, g, unknown or other
  misc_feature (180)..(180): n is a, c, g, or t
  modified_base (560)..(560): a, c, t, g, unknown or other
  misc_feature (560)..(560): n is a, c, g, or t
tcagagtacgctatcacgaccggtgctcgatttagctcgatatagttgggtctgggagaggagcccccgccctgggtttcccacggtgttctcatttggtgatcagcactgcacacagaagagtcatgacggagtttgggctgagcttgggttttccttgttgcttaatttttaaaggtntccagtgtgaggtgcagcgtgggtgggagtcgtggggggagtcgttgggtccacggccggtgggggggtcccctggacgtacctcttccctggtcgcacgcccttgtcggtactttccctacctttacaagtttatttatcgtctatcgacctcggtcgggtcccgccgacgggtcctaccggaaggggaacgggacgtaggtaattagttcgtccgtacgtaaggttaaattaaggtaaagttaacgtaggtaactaaaactaaactaagttaatttaagttaagtacgtaacctaaaccgttcgtaaggttaacggaagggtacaagttacctacccaacgtctaccgaccggtaagtaacctaacttaaccgaaacnccgtaggtcttaagtacttacccgttaagaacgtcggtcgacgttcgaagggtcaagggtcgtacgggaacgttacgtacggttacgttaaggtttaaccttggttaaccgggttaggggtacggggtaaggggtaaacccgttaagggggtaaacggtttaaacggggtttacgggttaccgggggtttaaagggggtttccggggaacccggggttaccgggggacccgggg

SEQ ID NO: 267510 - DNA, 851 bp, Homo sapiens
  misc_feature: GYAE6OF01E3S7T.28.57.F02.1.454.CMB.1.raw
  modified_base (789)..(789): a, c, t, g, unknown or other
  misc_feature (789)..(789): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgctatttttaaaggtgtccagtgtgaggtgcagctgggtggagtcgtgggggaggtcttcggtccaggccggttcggggggtccctgacgtactcctccgtgtcggcacgtccttcgtggtacttccgtaccgtttcgtacgtttaatttttagtacgtcttaagttcgaccgttaccggtccgggttaccccggaccgtacgggtcccttaacccggaaagggggtaaccggggtaacgtaagggtaacttaacttcggttacctacgtaaggttaaagtttaacggtaaaaggttaacgtacggtaaccgtaaaaacttaaaccgtaaatttaactttaaagtttacgtacgaacccttaaacggttaccgttagggtaacggtaaacggggtacctaacgttaaccgttaaccctaaccgttaacgttacccccggttaaaccggaacccggggttaaaacctaaaccggtttaaacccgaaaacgtaacccgtaccggttacgtttaacgtttaacctttaaccgttaacgtaaacggttcggaacctacggtacccgtaggacgagtcgtacggtaacggaccgtacggtctagttaatacgttacggtgggtaggaacggnggtagggtacgttaaggttaccgggtaaggttacggggtagggttccggggacggtacgggg

SEQ ID NO: 267511 - DNA, 751 bp, Homo sapiens
  misc_feature: GYAE6OF01BN0CL.28.57.F02.1.454.CMB.1.raw
  modified_base (181)..(181): a, c, t, g, unknown or other
  misc_feature (181)..(181): n is a, c, g, or t
  modified_base (623)..(623): a, c, t, g, unknown or other
  misc_feature (623)..(623): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggtagttgggctgagtcgttcgggttttccttgttgtcttattttaaggtntccagtgtgaggtgcagcgtgggtggtaggtcggtgggggacgtcgttcggtacccgtacgggtcccggtcggggggtcccctaggaccggtaccttcccgttccgtgtcgaccgtcgtccgttcgtagtacttcccgtaccttacgtagttattttagcgtacttagtcgtacgacggttccgggtcccgccgtacggtaccgtaaccggggaagggtaacggtacgtaaggtacttagtcgtcgtaacgtaggttaagtaaggtaacgtaagtacgaaacgtaaataacgtaattaacttagttactacgtaactaacgttacgtaaggtacggtaacggctagtacctacctactacgttaaccgtacggaaacgtactaaccgtaaccgaaagtaccctacgtcttactactacgtacgaaggtccggatccgtacgngacgtgtacgtcggacgacgtaactcgttagttaactaagttcggacgggtagggaaccggtaggaccggttaggtaaaggttacgggttacccgggtaggggttcggaccgggggtacgtacccggg

SEQ ID NO: 267512 - DNA, 196 bp, Homo sapiens
  misc_feature: GYAE6OF01ANIDF.28.57.F02.1.454.CMB.1.raw
  modified_base (196)..(196): a, c, t, g, unknown or other
  misc_feature (196)..(196): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagtgtgaggtgcan

SEQ ID NO: 267513 - DNA, 804 bp, Homo sapiens
  misc_feature: GYAE6OF01CA188.28.57.F02.1.454.CMB.1.raw
  modified_base (721)..(721): a, c, t, g, unknown or other
  misc_feature (721)..(721): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttatttttaaaggtgtccagtgtgaggtgcagctggtggagtcgtgggggagtcgttggtccagccgtgggggtccctgacgactcctccgtgtgcacgcctcgtggtattccaccttcgaagttatttagtcgtcttaatcggtaccgacggttcgggtccccgaccgaacgggtcccgttacccgggaaagggggtaacggggtaccgttaggggtaaacttaagtcgttaccctagggtaaggttaaagtttaaaggaaacgttaagtacggaaccgtaaaacttaaacgtaattaaagtttaatttaagtacgtaacccgtaaaaacttcggttaaggtaacggtaaagggtactaaacggtactttaacccgtaacccgtagttaccccgttaccggaaacgggtaaaccttaaacgttaacccgaaaacgaccgtacggttcgttaacgttacgttaaccttaacgaaacggtcgggaactaccgtaccgtaggtaacacggtcggttaggaacggtacgtaccggtagttagtacgttaccgtttaggngggttaacgggaagggtcgggtaaacggtagggtaacgttacgggaaacgggtttgggtcgggtcggggcccggtaaccgggg

SEQ ID NO: 267514 - DNA, 710 bp, Homo sapiens
  misc_feature: GYAE6OF01AYSZD.28.57.F02.1.454.CMB.1.raw
  modified_base (589)..(589): a, c, t, g, unknown or other
  misc_feature (589)..(589): n is a, c, g, or t
  modified_base (598)..(598): a, c, t, g, unknown or other
  misc_feature (598)..(598): n is a, c, g, or t
  modified_base (688)..(688): a, c, t, g, unknown or other
  misc_feature (688)..(688): n is a, c, g, or t
tcagagtacgctatcacgaccggtgctcgatttagctcgatatagttgggtctgggagaggacgccccccgccctgggtttcccaggtgttctcatttggtgatcagcactgcacacagaagagtcatgacggtagtttgggctggagtccttgggttttccttgttgtcttaagtttttaaaggtgtccagtgtgaggtcgcagcgtggtggtagtcggtgggggacgtcgttggtccgaggtccggttcggggggtccctaggacgtacctcgtccgtgtcgcacggtccttacgtcggttacttaccctaccgtttactaagtttattttagtcgtactaattcgcctacggtcgggtcccgccgacggtccctaccggaaggggtaacggctaggtaacttagtcgtacgtacgtaaggttaactaaggtaagtaacttcggaacgtaaaataactaagttaacttaagttaagtcaaacctaacgtgtaggtacggaaggtactaattcgtaccaaccgtattacccgaacgtacgacttaaactacgaaacgtacacgtcttatacttgaacttaagccgganacgtacgtnagcgtacgtacggacacgccggtataccgtaatttacgaggtaggtagggaagtcgggtaaagcggttaaggtaaaccggtgggttaggngggtaccgggtaggtacccggg

SEQ ID NO: 267515 - DNA, 618 bp, Homo sapiens
  misc_feature: GYAE6OF01ALQ11.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctggagactctcctgtgcagcctctggattcaccctttcagtatttatgctatgcacgtgggtcccgccaggctccagggaagggactggaactatgtctcaggtattaagaagtaatgacgaaataacataatattatgacaaactctagtagaaggcaagtactacaccacttacctaccgaagggtaaccaacttaccgaaaagaaccacgtcgtagtaacttcgttacaaagttacgggctaaggcctaggtacgagcgttagaaggacgaccgggtctagtaaatagttaacgtaggtacggggaaggaacgggtagggaccggtaaagttacgggtaaacgttagggggttaggtccgggggtaccgtaacggggg

SEQ ID NO: 267516 - DNA, 832 bp, Homo sapiens
  misc_feature: GYAE6OF01BU2E3.28.57.F02.1.454.CMB.1.raw
  modified_base (281)..(281): a, c, t, g, unknown or other
  misc_feature (281)..(281): n is a, c, g, or t
tcagagtacgctatcacgaccggtgctcgatttagctcgatatagttgggtctgggagaggagcccccgccctgggtttcccaggtgttctcatttgggtgatcagcactgcacacagaagagtcatgacggagtttgggctgagctggttttccttgttgcttatttttaaaggtgtccagtgtgaggtgcagctggtggagtcgtgggggagtcttggccagccgtgggggtccctgacgacctctccgtgtcgcagcctcgtggtacttctacccttntaacgttattttagcgtctatcgccgacgttcgggtcccgaccgtacggccttaccggaacgggggtaaacggaccgtaagggtaaacttcgttacggttaccgtacggttaaggttaacttaaaggaaacgttaacgtaggaaccgtaaaattaaaccgtaatttaatttaatttaacgttacggaaacccttaaaccttcgggttaacggtaaggggtaaacgggtacgtaaacggttaccttaaccctaaccgtaccgttactaacccgggtaacgggaaaccttaaaccggtaaccgaaaacggtaaccctacgtaccttagtttaacccttacgtaacgtaaggtacgggctaaccgtccgtaacggtacgtacggtacggtacgggaacggacccggtagtaccgttggttaaactttaacggttacggttaggggtaacggggaaagggtcgggaacggggtttaaacggttaaacggggtttcggggttaaacggtttaaggggggtccgggggttaccggggtaaccgggtaaacccggggg

SEQ ID NO: 267517 - DNA, 891 bp, Homo sapiens
  misc_feature: GYAE6OF01BRPZD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaatttttaaaggtgtccagtgtgaggtgcagtcgtggtggagtcgtgggggaggtcgttcggtccaggtcccggtcggggggtccctggacgtaccttccgtccgtgtcgcgacgccttcgtggtacttccgtaaccgttctagttatttagtcgtcgtaagtcgtccgtaccggttccggggtaccccggccggtacgggtcccgtaccgggaaagggggtaaacggggtacgttaagggtaaattaggttaccggtctacggtaaggttaaattaaggaaagttaagtacggaacgtaaaataaacgtaattaattaagtttatagtaaccttaaacgtcggttaaggtaaggaaacggggacctaaggttaccttaccctaaccgtaccgtaccgtaacccggaaacgggtaaaccttaaaccgttaaaccgaaacgtaaacccgtacgtaccgttagttaaccgttaaccgttacgtaaacggtccggtacggaccgttaccggtaaggaacgggtacggttacgtccggggaacgggtacccgtaaccggttcgttaaacggtttacttaacgggtttaacggtggggggttaacgggaagggggtaaccggggtaaacggggttaaaccgggttaaggggtttaacggggttaaacggggttttacgggggtttaaccggggggtccggggttaaaccggggggttaacccccggggg

SEQ ID NO: 267518 - DNA, 855 bp, Homo sapiens
  misc_feature: GYAE6OF01DJ8G8.28.57.F02.1.454.CMB.1.raw
  modified_base (220)..(220): a, c, t, g, unknown or other
  misc_feature (220)..(220): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagttgggctgagtcttgggttttccttgttgcttaagttttaaaggtcgtcagtgtcgaggtgcagtctggtcggagtcgtgggggngtcgttggtccaggccggttcggggggttccctaggacgtaccttcctccgttggtcgacacgccttcgaggttacttccgtaacctttctaagttttaatttagtgtacttacgtacgcggtaccggttcggggcccgtaccgtacgggtacccgtaccgggaaggggaacggggtactagggtaatacgttgtacctaggtaagttacttaagaaagtactacggtaacgaattaaactataattaattacgctaacctaacgttgtggtaaggtaacggtacgtacgtaaccttacgacccttaagtcccgtaaccggtaaggtaaacctaacgttaaccgaaaccgtaaacgtctactttaaaggttccttaacgtttaaccgtaaggttaccgggtaaccgtaccggtacgttaacggagggtaaccgtttaccgggtaaccggaacggttaccgggtaacccgttaaggtttaaacgtttaacggtttaacggtaccgggttaaaggggtaccggggtaaaaaggttaaccggggaaacggggttaccgggtttaaaggggtttacgggttaaaccggggtttaggggggtttaaccggggaccgggggtacgggggttaaaccccggg

SEQ ID NO: 267519 - DNA, 786 bp, Homo sapiens
  misc_feature: GYAE6OF01EZ7AG.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcttgggttttccttgttgcttaatttttaaaggtgtccagtgtgaggtgcagcgtggtgggagtcgtgggggaggtcgttggtccgaggccggttcggggggtcccctggacgtacctcctccgtggtcgccgacgtcccgttcgttcggtattccctaaccctttcgtaagtttaattttaacttcgtaccttagtcgacctaccggtccggggttccccggccgacgggtaccgtacccgggaagggggaaacggggtacgtagggtaaacttagttcgttaccgtaacgtaaggttaagttaaagtaaaacggttaagtacggaacgtaaaataaactaattaattaattagtacgtaactaaacgttcgtaggtaggtaacggacgtaagtactaccgtacctactaccgtaccgaaacggtaaactaaccgttaaccgaaacgtaaccgtacgttacgttaccgttaacttaccgttaaaccgtaaaggtccggacgtaacgtaccgacggtaagtacggtacgtaacgggtaacggaccggtacgtcgtaagttacgtaagttacggtagggtaggagggtaggaggtacggttaagtacgggtacggttagggtgggcggggtacggaacgggg

SEQ ID NO: 267520 - DNA, 671 bp, Homo sapiens
  misc_feature: GYAE6OF01DEYUR.28.57.F02.1.454.CMB.1.raw
  modified_base (173)..(173): a, c, t, g, unknown or other
  misc_feature (173)..(173): n is a, c, g, or t
  modified_base (268)..(268): a, c, t, g, unknown or other
  misc_feature (268)..(268): n is a, c, g, or t
  modified_base (445)..(445): a, c, t, g, unknown or other
  misc_feature (445)..(445): n is a, c, g, or t
  modified_base (531)..(531): a, c, t, g, unknown or other
  misc_feature (531)..(531): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgtggtttctgttgcttattttaaaggngtctagtgtgaggtgcagcgttggtgggacttcggtgggggagcgtttggtcccaggtcccggtggggggttccctgagtacctcgtcctaggtnccgagtcctcgtggtacttccacctttgatttattagtgtactagtcgctacggtcgggtccgccgtacggtccgtaccggaaggggtaacggtacgtaggtaaattggtccgttacgtagtaaggttaaagtagtaaggttaagcgtaacgtaaacttaaatatttaatagtttanacggtaactaacttcggaggttaacgagtaagtacgtatacccacgtactacgtacgacggtaaatctaacaaacggactaccgtntagtcttacactagacgtacacggtctagagtacgtggtaaccgacggagttccgacgttacgtacgtagttccgtagggtagggaacgagggtacgtagggtacgttagggtagttacgggttgggaccggttggacgg

SEQ ID NO: 267521 - DNA, 804 bp, Homo sapiens
  misc_feature: GYAE6OF01DJC6Q.28.57.F02.1.454.CMB.1.raw
  modified_base (352)..(352): a, c, t, g, unknown or other
  misc_feature (352)..(352): n is a, c, g, or t
  modified_base (571)..(571): a, c, t, g, unknown or other
  misc_feature (571)..(571): n is a, c, g, or t
tcagagtacgctatcacgaccggtgctcgatttagctcgatatagttggggtctgggagacggagcccccgccctgggtttcccaggtgttctcatttggtgatcagcactgcacacagaagagtcatgacggtagtttgggctgaggttcgttgggttttccttgttgtacgttagtttttaaaggtcgtccgtaggttggtggaggttgacgagtcgtgggtggtaggttcgggtggggggacgtcgttcggtccgacggtcccgggtcggggggtccctggaacgtaccttccgttccgtggttcggaccgacggtcccttcgtaggtaacctttcctaacccgttttnaacgttttaactttaacgtgtaccgttaagtcgacgtccggttccggggtcccgaccgtaccggtcgtacccgggaaggggacgggtacgttagggaaactggttagttaccgtacggtaaggttattaacggttaagttaagtcggaaaacgttaactaacgtattaacgtttaagtttcaggtaaacctaggttcgtaggtaaggacgggtaacgtnttacgtacctaccgtacttaccgacggtaacggactaaacgtacgaactaccgtacgtacgttataacgttccgtacgaaaggttggaccgtaagtccggtaagcggtagtcgaagggtcgacggtcgtagttaaggttacttaggtaggtcggagggtacggacggtacggtaacggtaagggttaccgggtaaggttacggggtttacggggcgggttcggtaaaccgggg

SEQ ID NO: 267522 - DNA, 1019 bp, Homo sapiens
  misc_feature: GYAE6OF01D3OY9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcttggggtttttccttgttgtacttaagtttttaaaggtgtccaggttgtaggaggttgcagtcgttgggtggacgtcggtgggggacgtcgtttcggtccgaggtccggtcggggggtaccctggacgtaccttcgtccgtggtcgcgacgtccttcgtaggttacttccgtaccctttagtaaggtttaattttacgtacgtaccttagttaccgtaccggtaccggttccggggttaccccgaccggtaccgggtaccccgttaaccggggaaaggggggtaacgggtaaccgttaagggtaaacgtttacgttccggtttaccgttaacggtaagggtttttaaattaaacgggtaaagtttaaacgtaccggtaaaacgtaaaacgtttaaactaagtttaaacgtttaaatttaacgtaccgtaaaccgttaaaacctttcgggtaggttaaacgggaaacggggttacctaaagggttacccttaaccgtaacccttacgttacccgtaacccggggtaaaggtaaaaccttaaccgttaaaccgaaaccgttaacggtacccgtttacgtttaacgtttacgtaaacccggtttaaacgtaacgggtaccgggtaacccgtacggtaaccggtaacggaaccggggttacgtaaccgggtaacgggtaacccgtaacccgggttacccggggttatttaaaccggttaaccgtttaaaccggttttggggtaacgggtaaagggggttaacgggaacgggtttaaccggggtaaacggttttaaacggggttaaacgggtttacgggggggttttaaggggtaccgggtttacggggggaaaccccgggtttaaacccgggggg

SEQ ID NO: 267523 - DNA, 709 bp, Homo sapiens
  misc_feature: GYAE6OF01EBDCK.28.57.F02.1.454.CMB.1.raw
  modified_base (178)..(178): a, c, t, g, unknown or other
  misc_feature (178)..(178): n is a, c, g, or t
  modified_base (621)..(621): a, c, t, g, unknown or other
  misc_feature (621)..(621): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtntccagtgtgaggtgcagctggtggagtcgtgggggaggtcgttggtccagcccggtggggggtcccctgagactcctcctgtgcacgcctcgtgacttccacctttcagttatttagtgactatgctacgtcgggtcccgaccgaggcctaccggaggggaacgggtacgtaggaattagttcgtctacgtaggttaattaaggaacgttaagtacgaacgtaaactaaactaattaattaattatacgtaacctaaacttcgtaggtaggaacgggctaagtacttaccaaccctattcccgaaccggaaggtaacctaaacgttaccgaaaagaacctccggtacttagttaacttacctaacgaaaggtcggaacacgtaccgtaggacgtacgtacgtagggaacgtaccgacggtgttaagttaactacgtttacggngggtagggaaggtacgggaacggtacgggttaaaggttccggggtaaaaggtttgggggttacgggtcgggggaccggtaaacggggg

SEQ ID NO: 267524 - DNA, 745 bp, Homo sapiens
  misc_feature: GYAE6OF01CDR30.28.57.F02.1.454.CMB.1.raw
  modified_base (674)..(674): a, c, t, g, unknown or other
  misc_feature (674)..(674): n is a, c, g, or t
  modified_base (692)..(692): a, c, t, g, unknown or other
  misc_feature (692)..(692): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtgggtggagtcgtgggggagcgttggtccgaggtccggtcggggggtccctggacgtacctcctccgtggtgccacgtcctcgtggtactttccaccctttcaagtttatttatgtcctatcgctacgtcgggtcccgccgacggcctacccggaagggggaaacggggtaccgtagggtaaacttagttcgttaccgtacgtaagggtttaactttaaaggtaaaggttaaagtacggtaaacgtaaaacttaaaccgtaatttaaagtttaacttttaaacgtcggtaaaccctaaaaccgtttcgttaggtaacgggtaaacgggactaaggttaccttacccgaaccctagttaccccgtacggaacgggtaaacctaacgttaacccgaaagaacccgtacgtcttacgttacttaccgttaacgaaaggtcgggacacgtccgtaggaacgtcgtacgtaggacgaccgnggtctagttatagttagnggtagggagagggacgtaggtagtaggtaaggttgggtggtcgggcgtacggg

SEQ ID NO: 267525 - DNA, 820 bp, Homo sapiens
  misc_feature: GYAE6OF01BZNX6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggtttccttgttgtcttattttaaaggtgtccagtgtgaggtgcagcgtggtggagtcgtgggggaggcgttggtccaggccggtcgggggtccctggacgtcctcctccgtggtgcacgtcctcgtaggtacttacctaccctttactaagttacttttaatcgtactacgtcgccgtacgtccggggtccccgaccgaacgggcctacccgggaagggggaacggtacgtaggaattagtcgttactccggtaaaggttagtaaaggtaacgttaagtacggtaacgtaaactaataagttaattaagttataagtaacctaaaccgtgttagtagggaaggtcaacggtactaccaactaacctccgtaccggaacggtaactaaaccgtaaccgaaagaccgtaacgtacctaacgttaaccgttacttaaccgtaaggtaccgggaacctacggtaccgtacggaacgggtaccgaacggttaacggaccgggtaacccggtaaccggtcgtttaaccggttaaacgttacccgtttaaggggtaccgggggtaggggaaaggggttcggggaaaagggttccgggttaaaaccgggttaggggttaacccggggtagggggggtttaaccggggtccggggggtacccggtaaacccgggggggg

SEQ ID NO: 267526 - DNA, 961 bp, Homo sapiens
  misc_feature: GYAE6OF01EA27U.28.57.F02.1.454.CMB.1.raw
tcagagtacgctatcacgaccggtgctcgatttagctcgatatagttgggtctgggagaggacgcccccgcccttgggtttcccaggtgttctcatttggtgatcagcactgacacacagaagagtcagtgacggtagtttgggctggagtcgtttgggtttttccttggttgtaccttttaagttttttaaaggtcgttaccgtaggttgtaggaggtgctagcgtgggtggaggtcggtgggggaggtcgttggtaccgacggtccgggttcggggggtacccctaggacgtaccttccgtcccgtgtacgaccgtacgtcccttcggtacggtaactttccacccgtttagaagtttaacttttagcgttactaacgttcgaccgtacggtccgggtaccccacggacggtccgtaaccggggaggggtaacgggtaccgttaaggtaattagtcgttacctagtaacggttaagttaagtaaagtacgagtaaaccgtaaattaaactatttaactttaagtaacgtaccgtaaacgttaaacgtttcggtaaagggttaacggaaaacgggtcttaaaccggttacctttaacccgaaacccgtaagtttaccccggtaaaccggtaaaacgggttaaacttaaaaccgtttaaacccgggaaaaacgtaaaccgttacccgttaaccgtttaaacgggttaccttttaaaccggtaaacgttaaacggggttaccgggaacgtaacccgggttaacggtaacgggtaacgaccggttaacgtacggggaaacggtacccgttaaggtaggtttacttaaaaggttaaccggtttagggtaacgggttacgggggaaggtaacgggtaacgggttaaaccgggttaaaggtttaaccggggtaacggggttttacggggggtacggggtaaacccggggcgggttaaacccggggg

SEQ ID NO: 267527 - DNA, 726 bp, Homo sapiens
  misc_feature: GYAE6OF01CYR9B.28.57.F02.1.454.CMB.1.raw
  modified_base (116)..(116): a, c, t, g, unknown or other
  misc_feature (116)..(116): n is a, c, g, or t
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (412)..(412): a, c, t, g, unknown or other
  misc_feature (412)..(412): n is a, c, g, or t
tcagagtacgctatcacgaccggtgctcgatttagctcgatatagttgggtctgggagaggacgccccccgccctgggtttcccaggtgttctctatttggtgatcagcactgcanacagaagagtcatgacggtgtttgggctgagtcgttgggttttccttgttgtcttaagttttaaaggtntcctagtgtaggaggtgcagcgtgggtggcgtggtgggggagtcgttggccncggtccggtcggggggtcccnggacgtcctccttcgtgtcgcacggtctgtaggtacttcctaccttgtattaattttcgctagtatcgaccgtacggtcgggtcccacgcggtaccgacggaaggggacggtactaggaactgtctacgtagtaagtaagttaagaagttaacnggaaactaaattaataattataattcggaactaacctaaatgtaggtaagaaccgatatacgtacatacttcgaacgagtaaactaactaacggtaacaaccgacgtacgttataaaccgtttacaaacggtaagtccgggataacccgttagacggaacgtcgtaaacgggcgaaacggtccgtaaccggatttaaaggaaacctttgggttaaaccgggtgggtaaaacgggcggtaaacggggtaccgtaaggggtaaacgttaggggttaaacgggttccgggggaaggtcgggggaaacgttaccgggg

SEQ ID NO: 267528 - DNA, 822 bp, Homo sapiens
  misc_feature: GYAE6OF01A2B7K.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttaaaggtgtccagtgtgaggtgcagctggtgagtctgggggagcttggtccagccgtggggggtccctgagactctcctgtgcagcctcgtggacttcaccttcagttactttaatgtactatgctacgtcggggtcccnccgaggtcctccggaaggggaacgggtaccgtaggaaatcgtaggtcctacgtaagggttaattaaggaacgttaaagtacggacgaaaagtaaacctaataattaattaactaggtaactaaaaccgtccgttaggttacggaaacgggggtcctaaaggtactttaccgaaacccttagttacccgtaacccgtaacggggtaaacctaaaccgttaacccaaaaggtaaacccgaaccggtaccgttacggtaacgtttaacccttaacgaaaacggttcggggacctaggtacccgttagggaagggtaccgtacggttaaggggaaccggaaccggacgggtacccgttaggttaaacgtttaacggttttaaaccggtcgggttaggggggtaaacggtaacggggtaaccggggtaaggttaaaaccgggtttagggggttaaaacccggtttaaagggggggtttaccgggggttaaacggggggttaccccggaaaaccgggggggg

SEQ ID NO: 267529 - DNA, 1017 bp, Homo sapiens
  misc_feature: GYAE6OF01CB867.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggtgtccagtgtgaggtgcagcgtgggtggagtcggtggggggaggtcgttggtccgaggcccggttcgggggggttcccctggacgtaccttcctcccgtggtcgcacgtccttcgtaggtacttcctaccctttacgtaggtttaattttatgtccttaagtcggactaccggttcgggggtccccggacccgtacggggtacccgttacccgggaaaggggggaaacggggtaccgttaaggggtaaactttagttcggttccgttaacgtaaaggggtttaaagttttaaaggtaaaaaggttaaacgttacggaaaccggtaaaaattaaaaccgttaaagtttaaatttaaattttaacgtaacggtaaacccttaaaaccgtttcgtagggttaacgggaaacggggaacctaacggttaacgtttaccaaacccgtaaccgttaccgtaaccggtaaaccgggtaaaccttaaaccgttaacccgaaaacgtaacccgtaaaccggttacccgttaacgtttaaacctttaacccgtttaaaccgtaaaacgggtttaccggggaacccgtaacgggtaaccccgtaacgggtaaagggtaccgggttaacggtaaccggggtaacccggggtaaccggtaacccggggttaccgtttaacgggtttaaaacgttttaacggttttaacccggttaaggggtttaaccggggggaaagggttaaaccgggggtaacggggtaacggggtttaaacggtttaacggggtaaacgggggttttaaggggggtttaccggggttacgggggggtaaccccggggtaaaccggggggg

SEQ ID NO: 267530 - DNA, 625 bp, Homo sapiens
  misc_feature: GYAE6OF01BCJSM.28.57.F02.1.454.CMB.1.raw
  modified_base (426)..(426): a, c, t, g, unknown or other
  misc_feature (426)..(426): n is a, c, g, or t
  modified_base (469)..(469): a, c, t, g, unknown or other
  misc_feature (469)..(469): n is a, c, g, or t
  modified_base (474)..(474): a, c, t, g, unknown or other
  misc_feature (474)..(474): n is a, c, g, or t
  modified_base (484)..(484): a, c, t, g, unknown or other
  misc_feature (484)..(484): n is a, c, g, or t
  modified_base (500)..(500): a, c, t, g, unknown or other
  misc_feature (500)..(500): n is a, c, g, or t
tcagagtacgctatcacgaccggtgctcgatttagctcgatatagttgggtctgggagaggagcccccgccctgggtttcccagggtgttctcatttggtgatcagcactgcacacagaagagtcatgacggagtttgggctgagctgggttttccttgtgctatttttaaaggtgtccagtgtgaggtgcagctggtggagtcgtgggggaggtcttggtccaggccgtgggggggtccctggacgactctcctgtgcgagcctctggattctacccttcagttatttatgctagtgcacgtgggtacccgccgaggcgtaccgaggggaagggtacgtggtaatatgtctacgtaggttaattaagaagtaagtgacgtaactaaacattaatattaatgactaaactcgtaggtaggaggganagtacttcgactactcaccgagggaactaacgtaccaagaccngactntacgtactanagtgggcagtccgtanacggtcagtcgacggacacggtcttagttatacgttaacgttgggtagggaggtagggtaacggtacggttaaaggttacgggtaaacgggttggggtttagggtccggggcgggtaaccggggg

SEQ ID NO: 267531 - DNA, 861 bp, Homo sapiens
  misc_feature: GYAE6OF01CGEDB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagcgttggtccagccgtggggggtccctgacgactctccgtgtgcacgcctgtggacttccaccttcagttactttatgtcttagtcgctacggttcgggacccgcgtacggccttaccggaagggggtaaacgggacgttagggaaacttacgttcggtaccgtacgtaaaggttaagttaaaggtaaaacgttaagtggaaaccgtaaaataaactaatttaattaaattagtacgtaaccctaaacgttcgttaagggtaacgggaaacgggtactaacgttacttaaccccgaaccttaacgtaccccgtaaaccccgggtaaagggtaaaccctaaacgtttaaaccccggaaaagtaaacccgtaccggtagtttaacggttacctttaaccgtttaaacgaaaggggttcccggtactaaccggttaccggtaacggaaggttaggtaccgtaaaggggtaacccgggtaaacggtacccgggtacttttaaaacggtaacgttttaaacgggttacggttacgggggtaaggggaaaaccgggttaacggggtaacggtaaacggggttaacgggtttaaacggggaaacggggttttggggggtacggggttacggggggaccccggttaaacgggggg

SEQ ID NO: 267532 - DNA, 817 bp, Homo sapiens
  misc_feature: GYAE6OF01AD3NT.28.57.F02.1.454.CMB.1.raw
  modified_base (680)..(680): a, c, t, g, unknown or other
  misc_feature (680)..(680): n is a, c, g, or t
  modified_base (719)..(719): a, c, t, g, unknown or other
  misc_feature (719)..(719): n is a, c, g, or t
tcagagtacgctatcacgaccggtgctcgatttagctcgatatagttgggtctgggagaggagcccccgcctgggtttcccaggtgttctcatttggtgatcagcactggcacacagaagagtcagtggacggtagtttgggctggagtcgttgggttttccttggttgtactttaagtttttaaagggtcgtccgtagtgtggaggtgcagtcgtgggtggacggttcggtgggggaggtcgttgggtacccgacggtccggggttcggggggttcccctaggacgtaccttccgtccgttggtcggacctacgtccgttcggttaggtactttacccgtacctttacgtaagttttacttttagtcgtacgttagtacgccggttaccggttccggggtccccgtcggacggtcccgtaccggggaaaggggtaacgggtacgtaaggtaattcgttcgtacgttacggttaaaggttaacgttaagggaagttaacgacggtaaacgtaaactaaacgtattaaatagtttacgacgtaacctaacgtggtacggtaagggaccgtacgtaagttacctaccaacgtccgttaaccggtacgaaacggtaacctaaccgttaaccgaaaacgtaccgtacgtacttacgtaacttacgtaacggtaagtcgggtacncgtacggtagacggtagacggagggaccgaccgttacgnttacgtaacgttcggtaggtgggtaagggcgtaaagggtcggttaacggttaacgttggggtaacgggttaggggcgggtacgggtcggtacccgggg

SEQ ID NO: 267533 - DNA, 691 bp, Homo sapiens
  misc_feature: GYAE6OF01C96Y9.28.57.F02.1.454.CMB.1.raw
  modified_base (299)..(299): a, c, t, g, unknown or other
  misc_feature (299)..(299): n is a, c, g, or t
  modified_base (545)..(545): a, c, t, g, unknown or other
  misc_feature (545)..(545): n is a, c, g, or t
  modified_base (627)..(627): a, c, t, g, unknown or other
  misc_feature (627)..(627): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatggacggtaggtttgggctgagtcgttgggtttttccttgttgtctttaagtttttaaaggtcgtccgtaggttgtaggaggtgcgagcgtgggtggaggtcggtaggggggtagtcgttggtccgaggtcccgggtcggggggtccctgacgtacttccgtccgttgtcgcncgtcctcgtagtactcctaccttgagtttattagcgtatatcgcgtcggtcgggtcccaccggaggtcctaccgggaagggtaacgggtagtagtaatgtcgtacgtagtagtataagtaagtacacgtaagtaaataatataacttataagtcaacctacgtgtaggtacggaggtacagttaacctcccaattccgtaccgtaacgaagtaaccctaacgtaacgaaacgacctacgtacgttnttaacgtacgtaacgaggtcgactacgcgtagacgatggaacgcggtacgtagtacgttagtaattcggtaggtaggggtanagggtacggacgggttagttaaacggttgggaacgggttcggggttagggcgggtcggtacggg

SEQ ID NO: 267534 - DNA, 916 bp, Homo sapiens
  misc_feature: GYAE6OF01B30ON.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggggtttgggctgagctgggttttccttgttgcttatttttaaaggtgtccagtgtgaggtgcagcgtggtggagtcgtggggggaggtcgttggtcccgaggtcccgtcgggggggttcccctggacggtaccttccgttcccgtggtcgcctacggtccccttacgtcgggtacctttcccgtaaccccgttttaccgtaaggttttaacttttaacgttcgtaccgtttaatcggtaccgtaaccggtttccgggggtacccccggcccgtaacggggtcccggttaacccgggaaggggggtaaaaccggggtacggtaaggggttaaacttagttacggttcctacggttaaagggttaagttaaaaggtaaacggtaaagtacggaacgtaaaacgtaactaaagttaattaagtttaacgtacgaaacttaaacgttcgtaggtaaggaacggctagtaacttaccgacctaacgttccgaaccggtaacgggtaaacccttaaacgttaacccgaaaagaaaccccgtacgttacgttaagttaaccctttaccgttaaacggtaaacggtccggggtaactaccggtaccggtaagggaaacggacggtaacccgggttagggaaacccggtccggtaacggttaccggttaagttaaaccgttagtttaccgggtagggtaacggggtagggaaaggggttccgggaacgttaaaggtttaccggggaaacgggtttggggttacgggtacccgggggcgtaacggggggtaccccg

SEQ ID NO: 267535 - DNA, 749 bp, Homo sapiens
  misc_feature: GYAE6OF01CUIOS.28.57.F02.1.454.CMB.1.raw
  modified_base (314)..(314): a, c, t, g, unknown or other
  misc_feature (314)..(314): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggacttccacctttcagtttatttatcgtactatcgacacggtcggggtcccnccgacggcctacccggaggggtaacggacgtagggtaattacgtcgtacgttacgtaggttaattaaggaaagtaagtcggaaccgtaaaattaaacctaattaataagtttaacgagtaacctaaaacgttcgttagggtacgggaaacggggtacctaaggtaactttacccgaaccttaacgttcccgtaacccggaaagggttaacctaaacgttaaacccgaaacgtaaccctaacggtcttaacgtacttaccgtttaacaagttcgggactaacgtccgtaggaagtacgtcgtacggtaacggacgaccggtattaggtaacttagttacggtagggtagggaacgggtagggtaacggtacgggtaaacgtttaggggaaacccggtttgggggttacgggaccgggggtcccggtaaacgggggg

SEQ ID NO: 267536 - DNA, 768 bp, Homo sapiens
  misc_feature: GYAE6OF01D18C2.28.57.F02.1.454.CMB.1.raw
  modified_base (439)..(439): a, c, t, g, unknown or other
  misc_feature (439)..(439): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacggtagtttgggctgagtcgttgggttttccttgttgtcttatttttaaaggtgtccgagtgtgaggtgcagtcgtgggtggagttcggtgggggaggtcgtttcggtccgaggtcccggttcgggggggtcccctaggacgtaccttccgttccgttgtcgaccacgtcccttcgtggtactttccctaacctttctaagtttattttatgcttatcgctacggtcgggtcccgccgacggcctaccgggaggggaacggtacgtaggtaatagttcgttctacgtaggttaagttaagtaagttaagngaacgtaaataacgtaattaatttaattatacgtaactaaacgttgtaggtagaagggtctaacggttacttacccgaacctacgttacccttaccggaaacggtaacctaaaccttaacccgaaacgtaaccgtcgttaccttacgtttacttacgttaacgaaaggttcggactccgtacgtaggaacgtgtacgacggaagtaccggacgtcgttaggttaaaccttagttaccggtagggtagggaagggtaaggtaacgggttacggtaaaggtttacggggtaacggtttgggggttacgggtcggggtaccggtacccgggg

SEQ ID NO: 267537 - DNA, 610 bp, Homo sapiens
  misc_feature: GYAE6OF01CAAZ3.28.57.F02.1.454.CMB.1.raw
  modified_base (170)..(170): a, c, t, g, unknown or other
  misc_feature (170)..(170): n is a, c, g, or t
  modified_base (184)..(184): a, c, t, g, unknown or other
  misc_feature (184)..(184): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
  modified_base (396)..(396): a, c, t, g, unknown or other
  misc_feature (396)..(396): n is a, c, g, or t
  modified_base (410)..(410): a, c, t, g, unknown or other
  misc_feature (410)..(410): n is a, c, g, or t
  modified_base (461)..(461): a, c, t, g, unknown or other
  misc_feature (461)..(461): n is a, c, g, or t
  modified_base (496)..(496): a, c, t, g, unknown or other
  misc_feature (496)..(496): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctatttaaggngtcagtgtgaggtncagcgtggtggagtcgtgggggagtccttggccagccgtggggggtccctgagctctcgtgtgcagtcctnaggtnttcaccttnattatttatnctatgcgtacctgggtccncctaggctccgaggggaacgtacgtaggaatcttggactacgaaggttattagaagtagtacgacgaataacattagtaattacgacgactaaacgtntaggtagaacgganaacgtattaccactacgtctacgaacggtaacattaacccaaggtaacccngtactagtactacgtaacgtaagtcggcacgtagngaacgtgacagaacggtacacggtcttaatacttacgtaggagggtagaaggaggtacggaggttaaacggttaggtaaacgggttagggttcgggaaccggggtcgaacgggg

SEQ ID NO: 267538 - DNA, 773 bp, Homo sapiens
  misc_feature: GYAE6OF01ASIVG.28.57.F02.1.454.CMB.1.raw
  modified_base (687)..(687): a, c, t, g, unknown or other
  misc_feature (687)..(687): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtggggagtcgttggtcccaggtccggtcggggggtccctggacgtcctcgtccgtgtgtcacgtccttcgtaggtacttccctaacccgtttctaagttattttaagtcgtacttacgtcgtccgtaccggttcggggtccccgaccgtaacggtccctaccgggaaggggtaaccgggtacgtagggtaaaatcgtacggttctaacgtaaggttaacttaaagggtaaaccgttaacgttacggaaacttaaaacttaaactaagtttaaatttaagtttaagtaacgtaacccttaaaacgttcggttaggtaagggaaacggtccgaaagttacccgtaccaaccgttaacgttcccgaaccggtaaacgtaaccgtaacttaaccgaaacgtacccaagtcgttacgtaattcccgaagtaaaggtccgggactaacgtccgagtaggacgttggaacggaggacctaccggttntacggtttattaagtacgggtggtacgagggttccgagggtaccggtattacggggtaaacggtggtcgggtagggccgtaagggg

SEQ ID NO: 267539 - DNA, 792 bp, Homo sapiens
  misc_feature: GYAE6OF01DL5YG.28.57.F02.1.454.CMB.1.raw
  modified_base (182)..(182): a, c, t, g, unknown or other
  misc_feature (182)..(182): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgtcttaagttttttaaaggngttccagttgtgaggtgcagcgttgggtggaggttcggtgggggaggtcgttcgggtccaggtcccggttcggggggtcccctggacgtcctcctccgtggtcgcacgtccttcgtggtacttcctacctttcgtagtttatttagtgtacttagtcgacgtacggttccggggcccgccgtacggtccgtaccgggtaagggggaacggtacgtaaggtaattagttacgtccgtagtaagttaagttaaggaaagtaagtagaaccgtaaaattaaactaagttaatttaattaagtacgtaactaacgttcgtaggtaggaaagggctaagtactaccaccgtaactcgtacgaggtaacctaacgttaaaccgaacgtaaccacgtaccttagttacgttaccgttaacgaagttccgggactacggtaccgtaggaggtacgcggttacgaaccgggtaccggtcggttaacttagttaaacgtttaagttcggggttagggttaaggggaacgggaaacggggtaacggttaagggttaaacggggttacgggttaaacggggtttaggggttaccggggtacgggggccgggtaaaccggggg

SEQ ID NO: 267540 - DNA, 1057 bp, Homo sapiens
  misc_feature: GYAE6OF01D7LIP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagcgtggtggagtcgtgggggagtcgtttcgggtccaggcccggttgggggggtcccctggacgacctcctccgttgtcgccgacgtcccttcgttcgggtactttcctacccttttcgtaagttttaacttttaagtcggtacctttagtcggtacctacggttccgggggttaccccgaccgtaacgggcccgttaacccgggaaaggggggtaaacgggtaccgttaggtaaacttaacggtcgttaccgttagaaagggtttaagttaaagtaaaaggttaagtacggaaacgtaaattaaaactaagttaaattttaagttaactacggtaaaccttaaaaccgttcgttaggtaaaacggggaacgggtaaccctaaggttaacccttaacccgtaaaccccgttaacgttaccccgtttaacccggggaaaacgggttaaacccttaaacgtttaaaccccgaaaaaccggtaaccccgtaaccgggtttacctttaaggtttaaccctttaaccggttttaaacccgaaaaggggttcgggaacctaccggtttaccggtaaggaaacgggtacgtaaccgggttacgggtaaacgggaccccggttaaacgggttacgtttaacgggtttaaacgttttaaaccgggtttaaccggggttttaaacggggggaggggggtaaaaaccgggtaagggggttaaaaccccggggggttaaacccggggtttaaaaaggggtttaaaccccggggggggtttttaaaaacccgggggtttaaaggggggggttttttcccgggggggaaacccggggggggttaaacccccggggggttaaaaacccgggggggggg

SEQ ID NO: 267541 - DNA, 824 bp, Homo sapiens
  misc_feature: GYAE6OF01CHS1I.28.57.F02.1.454.CMB.1.raw
  modified_base (664)..(664): a, c, t, g, unknown or other
  misc_feature (664)..(664): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagtcgttgggttttccttgttgtacttaagtttttaaaggtgtcctagtgtgaggtgcagtcgtgggtggagtcggtggggggacggtcgttgggtcccgacggtccgggttcgggggggtcccctaggaacgtccgttccgtcccgttggtcgccgtaacgtcccgttcggtacggttacctttccctacctttactaaggtttaattttacgtgtaccttagttcgaccgtaccgggtccggggtacccccgaccggtaccgggtaccgtaacccggggaaagggggtaaacgggtacgttaagggtaaacttacgttacgttaccgtacggttagggttaaattaaacgggtaaagttaaagtcgaaacgtaaaacttaaacgtaattaagtttaatagtaactaacgtaacttcggtaggtaaggaacggtactagtacctaccgaactacgtaccgacggtaaacggaacttaacgtaccgaaaagccgtacgttatacgttactaccgttaaanaggtcggactacgacgagtacggacgttggaacggaacggtctaccggttaattgttaaattaaccggtttgggacgggttaagggacggtaagggtaccggttaaggtaaggttacggggtaagggtttgggaacgggggtccggcggggtaacccggg

SEQ ID NO: 267542 - DNA, 721 bp, Homo sapiens
  misc_feature: GYAE6OF01ERFDX.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctatttttaaaggtgtccagtgtgaggtgcagctggtggagtcgtgggggagtcgttggtccaggccgtggggggtcccctggagacctctcctgtgcacgccctctggtattcctaccttctagttatttatgtctatgcgtacgtcggggtacccgcccgtagggcctaccggaagggggaaaggggtacgtagggaaattagttcggtaccttacgtaaggtttaatttaaggtaaagttaagtacggaacgtaaaattaaacctaattaatttatttaagtacgtactaaaaccttcgtaggtaaggaacgggtacagtaaccttccaacctatcccgtaccggaagggtaaacctaacgttaccgaaacgaaccgtacgtacttagttaacttaccgttaacaaaggttcgggactacggtacctaggacgtacgcggtaagacggaccgtacgtcgtttagttatacgtttacgtggggtagggaagtggggaagtaccggtaaaggttagggtaaacgggttaggggttcgggacggggcgtaaaccggggg

SEQ ID NO: 267543 - DNA, 825 bp, Homo sapiens
  misc_feature: GYAE6OF01ESZ3Y.28.57.F02.1.454.CMB.1.raw
  modified_base (591)..(591): a, c, t, g, unknown or other
  misc_feature (591)..(591): n is a, c, g, or t
tcagagtacgctatcacgaccggtgctcgatttagctcgatatagttgggtctgggagaggacgcccccgccctgggtttcccaggttgttctctagtttggtgatcagcactgcacacagaagagtcatgacggtagtttgggctggagtcgttgggtttttccttgttgtacttaagtttttaaaggtcgtaccgtaggttgtggaggtgcagtcgtggtggaggttcggtgggggagtcgttcggtccgaggtccggttcgggggtccctggacgtaccttcctccgttgtcgcgacgtcccttcggtacggtacttcctacccgtttacgttaagtttacgtttaagtcgtacttaagtcggtacctaccgggttccggtccccggaccgtacggtacccgtacggggaaagggggaacgggtaccgtaggtaaacttgttcgtctaaggtagttaagttaagtaaacgttaagacgtaacgtaaataactaagttattacttagtacaactaaactcgttaagtacgggaagtcgtaatactccaactacgtaccgtaccggaaaggtaacctaacgtaccgaaanaccgtcgttacttaagtaccctttagtaacgtaacggccgtagtaccgtaacgcggtaacgtacgtacggaacggacggtaaccggtacgtaacgttagtttaaaccgtaggttttaaccgggtaggggaagggtaaaggttaccgggaaggtttaaacccgggtaaagggtttaaaccggggttacggggttaacgggggttccggggtaaaccggggccggttaaacggggg

SEQ ID NO: 267544 - DNA, 651 bp, Homo sapiens
  misc_feature: GYAE6OF01CNXO5.28.57.F02.1.454.CMB.1.raw
  modified_base (644)..(645): a, c, t, g, unknown or other
  misc_feature (644)..(645): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccgaggggaagggactggaatatgtctcaggtattagaagtaatgacgaataacatatattatgacaaactctgtagaagggcagattcaccatctccgaggacaattccaaagacacgctgtatcttacaaatgggcagctgagagctgacggacacggtctagtatattacgtggtagggagaggagacggtaagttaggaacgtgggttggtcggggaccgagggacgcccgtggtacctaccgtctcctacgacgccctaccgaaccgaacgggtccctagtccggttacccttcccccgtcgggccccgtcccgtcgcccgtaccgacggtacgcccgtaccgtccgacggacgaccgaccgacggcccggcccgtgggtcctcggtccgtacgggtaaccaacggtacccttacccgttacgaacgttacggtacccgttaccgtcgtacgggacgggtaccgggtcgtacggggaccgtaaacggggccgtaacctaaggtacggnngcgtag

SEQ ID NO: 267545 - DNA, 933 bp, Homo sapiens
  misc_feature: GYAE6OF01CNZQT.28.57.F02.1.454.CMB.1.raw
  modified_base (102)..(102): a, c, t, g, unknown or other
  misc_feature (102)..(102): n is a, c, g, or t
  modified_base (796)..(796): a, c, t, g, unknown or other
  misc_feature (796)..(796): n is a, c, g, or t
tcagagtacgctatcacgaccggtgctcgatttagctcgatatagttgggtctgggagaggacgcccccgcccttgggtttcccaggtgttctcatttggtnatcagcactgcacacaagaagagtcagtggacggtagtttgggctggacgtcgtttcgggtttttcctttggttgtacgttttaagtttttaaacgggtcgttaccgtagttggttaggtacgggttcgacgtcggtggttggggtgggtacggttccgggttagggggggacgttccggtttcggtaccggtacggtccggggttacgggggtccctggaacgtccttcgtccgtgtacgcgacgtcttcgtagtacttccgtaccttcgtaagtttaatttgcgtacttacggttcgacccgttacgggtccccgggtccccgtacggtaccgggttaccggcggggttaaacggggaacggtaccggttaagggtaacttacgttaccggtttaccgggttacgttaaggtttaaaggttaaacggttaaggtaaacgttaccgggtaaacttaaaaacgtcgttaaattaaaggtttaccttaacggtacggtaaaaccttaccggtttggtaaacggtaacgggtaaaccgtacttagtaccgttaccgaacctaccgtacgtacggtaacggtaacttaacgtaacgaataacccgtacgtgtttaactaccgttacgtaacgttaggaccgttagtaacgttcccgaaggtacacggtacggtagtaccggtaaccaacggggtttnttaaaccggttaacggttacgttacggggttaaggaccggggtaaaggtaccgggttaagggttaaacccggtttcgggttaaaggggttaccgggtttaggggttcgggggtaaccggtaccccggggtaaacggg

SEQ ID NO: 267546 - DNA, 724 bp, Homo sapiens
  misc_feature: GYAE6OF01A0QX4.28.57.F02.1.454.CMB.1.raw
  modified_base (317)..(317): a, c, t, g, unknown or other
  misc_feature (317)..(317): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
  modified_base (621)..(621): a, c, t, g, unknown or other
  misc_feature (621)..(621): n is a, c, g, or t
  modified_base (670)..(670): a, c, t, g, unknown or other
  misc_feature (670)..(670): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggtttttccttgttgtcttaagttttttaaaggtgtccagtgtgaggtgcagcgtggtggtagtcggtgggggaggtcgttggtccgacggtccggttcggggggtcccctgacgtcctctcgtgtcgcacgcctgtaggtcttctaccgttctagtttactttgtntactagtcgaccgtacggtccggggtccccgaccggtaccggtacccgtaccgggtaacgggggaacggtacgtaaggtaattagtcgttacgtacgtaagttagttaagtaagttagtacgtaacgtaaactaaacgtacttaatattaacgtacgtaacctaaccgtagttacggtaaggtacggtaacgtacgttacttacgacctaccgtaccgtacggtaaacggaacttaaccgtaacaaacgtacctaggtccttagtacttaccgtaataaggcgtanaccgngtacgtagaccgngtacgacggtactcgtatgttagtacgtggtagggagggagtaacgggngtaacggttagttacgggtaacgggtttgggtcggggtaccggacgggtacggg

SEQ ID NO: 267547 - DNA, 718 bp, Homo sapiens
  misc_feature: GYAE6OF01AYVWY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtggtggacgtcgtgggggaggtcgttggtccgaggcccgttcgggggggtcccctggacgaccttccgtccgtggtgccgtacgtcccgttcgtggtactttcctaccctttagtaggttatttatgtactattcgacgtacgtcggggtcccgaccggacggctaccggagggtaacgggacgtaggtagtacgtgtactacgtaagttaagttaagaaagtagtacgacgtaaataacgtaattaagttacttatacgaactaaacttcggtaggtaggaagggtactaacgtacttaccgaacgtactacccggtacgaacgggtaacttaacgtaccgaaaggtacccgtactacgtacttacgttactaacgtaagcggactagccgtaggacgtactacgacggacgaccgaacgtcgttataacgtgttaaggtcgggagggacggtaaggacggtaacggtaaaggtttcggtaaccgggttgggttacggggaacgggtcggtaaccgggg

SEQ ID NO: 267548 - DNA, 747 bp, Homo sapiens
  misc_feature: GYAE6OF01A8DN9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgtcttaagtttttaaaggtgtccagtgtgaggtcgcagcgtggtggagtcgtgggggagtcgttggtccaggtccggtcgggggtccctggacgactctcctgtacgctacgcctcgtggtacttcctaccctttgtaagttatttaagtcggtattacgtcgtaccgtacggtcgggttccccgacgtacggccctaccggaaggggtaaacggtacgtaaggtaatagtcggtactacggtaaggttaagttaagtaaagtagtacgaacgtaaactaaacgtattaagtattactagaacctaaacgttgtaaggtaggaaacggtactaacggtacttaccgaactcgttacctacggaacgtaaacttaacgtaaccgaaacgacctacgtacttagttaccttaaccgtaacgtaacggtcgtacgaacgtcgtaggagtacggtaccgtaagggaaccgtaccggtaaccgtgttaacggttactttaaggtaccggtttagggacgggtaaggtaaccggggtaagtggttaaaccggtggtaaacggttggggtacggtccgggacggtaacggg

SEQ ID NO: 267549 - DNA, 621 bp, Homo sapiens
  misc_feature: GYAE6OF01A0H5R.28.57.F02.1.454.CMB.1.raw
  modified_base (260)..(260): a, c, t, g, unknown or other
  misc_feature (260)..(260): n is a, c, g, or t
  modified_base (492)..(492): a, c, t, g, unknown or other
  misc_feature (492)..(492): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggaggcttgggtccagcctggggggtccctgagactctcctgtgcagcctntggattcaccttcagtatttatgctatgcactgggtcccgccaggcctccgaggggaacgggtctaggaatatgtctacgaggttattagaaacgtaagtgaacgtaaataaacgattaatattatcgaactaaacttcgtagtaggaagggcagtattaccaacctatcctaccgaagggaaccaacgttaccaaacgaacacgtatacgttatacttacaaagtcggacnaccgtgagactgtaggacgactacgggcttaggtattaacgttacgtaggtaggggagtaaggggtacggaacgggtaagttagggaaacccggttaggggttggtacgggggtacccggtaacggggg

SEQ ID NO: 267550 - DNA, 652 bp, Homo sapiens
  misc_feature: GYAE6OF01BNUVG.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttccaggtgttctcatttggtgatcagcactgcacacagaagagtcatgacggagtttgggctgagctgggttttccttgttgctattttaaggtgtccagtgtgaggtgcagctggtggagtcgtgggggagcttggtccaggccgtggggggtccctgagactctcctgtgcagcctcgtggacttcaccttcagtatttatgctatgcacgtcgggtccncgaggcctccgaggggtaacgggactagggaatagtgttcctacgtaagggttaattaaggaagttaacgttgaacgtaaactaaacaattaattaatttaagtgaactaaaacttcgtgtaggaaacgggctaagtattacacctatcctaccgagggaactaacgtaccaaagaacacgtctagtattctactaaagtcgggactaacgcctaggacgaagccgtaggaacggaccgacgggtccgttagttaacgtaagtttaccggtgggttaggggaggtagggtaggaaccggttaggttacgggtaaggtttaaggggtgggttacggggggaccgtaacggggg

SEQ ID NO: 267551 - DNA, 800 bp, Homo sapiens
  misc_feature: GYAE6OF01DT570.28.57.F02.1.454.CMB.1.raw
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttatttttaaaggtgtccagtgtgaggtgcagtcgtgggtggagtcggtggggggaggtcgttcgggtaccgaggtcccggttcgggggggtcccctggacgtaccttcctcccgtagtcggacacggtccttcgtaggtactttccgtaccttcgtaagttatttactgtctatcgctacgtcgggtcccgccgacggtccgtaccggaagggggtaacggtacgtaggtaattgtacgtactacgtaaggttaattaagaaatagtagacgtaaataaactattaattattaanacgtaacgtaaattcgtaggtaacgtaaagggtactaagtaacttaaccgacccttaactacccgtaaccggtaacgggtaacctaaaccgttaaccaaacggtaaccgccggtacgttacgttaactttaaccgtacgtaaacgtacgggacctaacggtccgtaaggaaccggtagtacggtacggaacggtacgacggttacttaaggttactttaaacgttcgggttagggtaaggggtaacggggtaaacgggtaacgggtaaggttaacgggttaagggttaaaccgggtttggggggttaaccggggtccggggaaccgggtaaccgggggg

SEQ ID NO: 267552 - DNA, 853 bp, Homo sapiens
  misc_feature: GYAE6OF01B4M1Y.28.57.F02.1.454.CMB.1.raw
tcagagtacgctatcacgaccggtgctcgatttagctcgatatagttgggtctgggagaggagcccccgccctgggtttcccaggtgttctctatttggtgtatcagcactgcacacagaagagtcatgacggagtttgggctgagctgggttttccttgttgtcttatttttaaaggtgtcctagtgtgaggtgcagctggtggagtcgtgggggaggcgttgggtccgagccggtggggggtccctggacggtaccgttccgtccgtgtcgccgtacgtccctcgtcggtactttcctacccgtttctaacgtttattttacgtgtaccttaagtcgtccgtaccggtcggggtcccgaccgtacgggtcccgtaccggaaggggaacgggacgtaggtaagtacgtcgtcgtacgtaaggttattaaggtaacgtaacgtgtaacgtaaataacgtaattaagtttaattaacgttacgtaactaaacccgttacgttaggttaaggaacgggtaccgtaagtaccttaacccgtaccttacgtaccgtaaccggaacggtaaaccttaaccttaaccggtaaaacgaacccgttaccggtactttacgttaattaacctttaaccggaaggttccgggactacggtcggtaggaacgttacgtaccggtacggaacgggtaccctaacgggttccgttaagtagttttaaaccgttccggaagggggttaccgggtaaacgggaaagggtacggggttaaacgggttaaacgggtttaaaccggggggttaacggggtttaagggggggtttaccgggttaaccgggggacccgggggttaacccgggg

SEQ ID NO: 267553 - DNA, 698 bp, Homo sapiens
  misc_feature: GYAE6OF01ALDPO.28.57.F02.1.454.CMB.1.raw
  modified_base (310)..(310): a, c, t, g, unknown or other
  misc_feature (310)..(310): n is a, c, g, or t
  modified_base (557)..(557): a, c, t, g, unknown or other
  misc_feature (557)..(557): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttcctttgttgtacttaattttttaaaggtgttccgagttgtgaggtgcaggctgggtgagtcggtgggggagtcgttggtccaggtccggtgggggtccctagacgtaccttcgttcctggtcgccacgtcctcgtacggtacttccgtacctttntaagttattttatcgtccttagttcgacgtaccggttcgggtacccgcggaccggtccgtaccgggaagggacgggtaccgtaggtaagttagttcggttactacgtaaggttaataaggtaagttaagacgtaacgtaaataactaattattaatatacgtaacttaactcgtagtaggacggtacagtactacactcgtcgacgtaacgaactacgtaacaacgtacagtctagtactacgttanaagtcggacacgacgtagacgtgacgagaaggaccgtcggacgttatagttaacgttagtagggtaggaacggtgggtaacggttaagggtaacgttacgggtaacggttagggggtacggggtacgggtcgggtacgggg

SEQ ID NO: 267554 - DNA, 761 bp, Homo sapiens
  misc_feature: GYAE6OF01CZNL4.28.57.F02.1.454.CMB.1.raw
  modified_base (639)..(639): a, c, t, g, unknown or other
  misc_feature (639)..(639): n is a, c, g, or t
  modified_base (677)..(677): a, c, t, g, unknown or other
  misc_feature (677)..(677): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacggtagtttgggctgagtcttgggttttccttggttgtcttaatttttaaagggtcgttcctagtgtgaggtgcagtcgtggtgggagtcggtgggggtaggtcgttggtcccgaggtccggtcggggggtccctaggaacgtccttccgtcctggtcgaccgtacgtccttcgtaggtacttcctacctttacgtaagttaatttagtgtactagtgtccgtaccggttccggggtcccgaccgtacggtacccgtaccgggaaacggggaacgggtacgtagggtaacttacggttacgttaccttggtaaagggtttaatttaaacgggtaaaatttaccggtaagtaaacgtaaaacttaaataatttaattaagtttaacgtactaaccttaaacgtcgttaaggtaggaaaggtccgtaagtacttacacctaactccgacgtaaggaaaccttactaaccgaaagacaccgttagtacgttataccgtagaaggtccggtaanccgtaacgtgaacggtacgagcggaccggataccggtnttagttacttagtcggtaggtaggaggtaggaggaaggttacggtaaagggtacggtaggggtcggtacgggccggtaacgggg

SEQ ID NO: 267555 - DNA, 826 bp, Homo sapiens
  misc_feature: GYAE6OF01CQKAW.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcgtgggggaggtcttggtccaggccgtgggggtccctgagactctcctgtgcacgcctcgtggtacttccgacctttctaagttattttagtgtaccttatcgtacctacggttccggggtcccgccgacggtccgtaccggaagggggaacggtaccgtagggtaaattagttacgttccgttacgtaaggtttaagttaaaggtaaagttaaagtacggaacgtaaaattaaacgttaatttaatttaacgtttaagtacgtaaacctaaaccgtttacggttaacggtaacgggaaacgggtactaacggttaacctttacccgaaccctaacgttcccgtaacccggaaacgggttaaaccctaaacttaacccggaaaacgtaacccgtaccggtctttaagttaccttactttaacgaacggttacgggaccaacgtaccgtaggtaacggtacgtcggtaaggaacgggtaccgtaccgggtactttaacgttaacgtttacgttacgggttaggggtacggggtaaaggaagggtacggtaagggttaaaggtttacgggggaaaggtttcgggggttaaccggggtcggggtaacccgggtaaccgggg

SEQ ID NO: 267556 - DNA, 784 bp, Homo sapiens
  misc_feature: GYAE6OF01B83C5.28.57.F02.1.454.CMB.1.raw
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttagttttaaaggntccagtgtgaggtncagcgtggtggagtcggtgggggagtcgttcggtaccacggtccgtcggggggtccctaggaacgtacctcgttccgtgtcgcgaacgtcctcgtaggtacttaccgaccttactaaggttatttaagtcgtaccgttagtcgaccgtacggtccggggtacccgaccggtacggtacccgtaccgggaaaggggtaaccgggtagtaacggtaagttacgtacggttactaacggttaaggttaaacgttaaaggtaaaacggttaaagtacggtaaaccggtaaaaattaaaccgtaattaaagtttaacttaacgtaacgtaacctaaaacgttccgtaggtaacgggaacggtaactacggtaaccttacgtaacctactaccgaccgtaaacggaaactaacgtaacgaacgaacacgtatacgtataccgtaagtaacgtggaactagacgtagacgtaagtacgtacgaacggtacggaccgtagtaagtaagttaacgtaggtacggtaagggtaggaaggtacggtaaggtaaaggttaggtaaacgggttagggtacgggtaacgggtcggtaaaccgggg

SEQ ID NO: 267557 - DNA, 814 bp, Homo sapiens
  misc_feature: GYAE6OF01EKQHW.28.57.F02.1.454.CMB.1.raw
  modified_base (618)..(618): a, c, t, g, unknown or other
  misc_feature (618)..(618): n is a, c, g, or t
  modified_base (655)..(655): a, c, t, g, unknown or other
  misc_feature (655)..(655): n is a, c, g, or t
  modified_base (800)..(800): a, c, t, g, unknown or other
  misc_feature (800)..(800): n is a, c, g, or t
tcagagtacgctatcacgaccggtgctcgatttagctcgatatagttgggtctgggagaggacgcccccgccctgggtttcccaggttgttctctatttggtgatcagcactgcacacagaagagtcatgacggtaggtttgggctggagtcgtttgggtttttccttgttgtacgtttaagtttttaaaggtcgtccgtaggtgtggaggtgcgaggtcggtgggtggtaggttcgggtgggggaggtcgttacgggtcccgacgggtcccggggttcggggggttccctaggtaccgtaccttccgttccgtgtcgccgtacgtcctcgttacgtaccttccttaccttacgttaagtttacgtttatcgttacctagtcgtaccgtcggtccggtcccgcggacggtccgaacgggaaggggaacgggtacgtaggtaattcgttgtacgtacggttaaggttaaagttaaaggtaagtagtaacggtaacgtaaaataactaattattattaactaacgactaacgtacgtaggtaacggacgtactaagtacctcctaaccgttgtacccgtaacgggaaacgtaaactaacccgtaaacgaacctaccggtntacttacgttaagtaccgtaaagtaacggtccggganaacccgggtgtaacggaacggtcgtagggacggtaaccggtacgttaggtactttaaggttaaccggtagttaccgggaggggtaagggtagggacgggtaattacggggtaaattacggggtaacggggtttagggacccgggnggttacgggccggg

SEQ ID NO: 267558 - DNA, 730 bp, Homo sapiens
  misc_feature: GYAE6OF01AF0YJ.28.57.F02.1.454.CMB.1.raw
  modified_base (286)..(286): a, c, t, g, unknown or other
  misc_feature (286)..(286): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (514)..(514): a, c, t, g, unknown or other
  misc_feature (514)..(514): n is a, c, g, or t
  modified_base (635)..(635): a, c, t, g, unknown or other
  misc_feature (635)..(635): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtctttaagtttttaaaggtcgtccagttgtggaggtgcagcgtgggtcggaggtcggtgggggagtccgttggtaccgcggtccggtgggggtcctggaagtcctcctccgtagtcgacncgtcctcgtagtactccgtcttacgtagttattagntntatgcgtacggtccggtccgacggtccggtccgtaaccggaaggggtaacggtacgttaggaaacgtcgttcgttacgtacggtaggttaagtaagtaacgttagacgtaagaactagtaacttattaattcgtacaaacttaactcggttggaaggtacggaccttaggtaccttacgacccgtttaancccggttaacgaaggtaacctaacgtaaccgaaacggacctagttacgtacgttaacgtccgttaaacgtagggccctaacgcggtttaccgagaggtgtaacccggtagaaccgtacggntttcggatttaacccgtgttaaggtcgggtagggaggtacggtacgaggtttacgtaggtaaacgggttcggtcggggaggtacggtacccgggg

SEQ ID NO: 267559 - DNA, 854 bp, Homo sapiens
  misc_feature: GYAE6OF01CCTB0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggtttttccttgttgcttagttttttaaaggtgtccagtgtggaggtgcagcgtggtggagttcggtggggggaggtcgttggtccgaggtcccggttgggggggtcccctggacgtaccttccgtcctgtcgccacgtcctcgtaggtacttcccaccctttctaagttatttagtgtcttagtcggctacgttccggggtcccgaccgacggtcccgtaccggaagggggtaaggggaccgttaggaaagttacgttggttaccgtacggtaagggttattaaaggtaaaaggttaagtacggtaaccgtaaaaattaaacgtaagtttaaattttaatttaagttacggtaaacttaaaaccttcgtagggttaggaaacgggtacgtaacggtaactttacccgaacccttaagttcccccgttaaaccggaaagggtaaacccttaaacgttaacccgaaaacggtaaacccgtaaccgtaccgttagtaacctttaccgttaaacgtaaacggttcgggactaacgggtaccgttaggtaaggaccgtcggtaacgggaacgtaccggtacggtacttaaggtcgtttaaaggtttaccggagggttagggggaaacgtaggggaacggtaagggtaacggtttacggggtaaacgggtttaggggtttcggggttccggggaacggtaacccggggg

SEQ ID NO: 267560 - DNA, 782 bp, Homo sapiens
  misc_feature: GYAE6OF01BMESA.28.57.F02.1.454.CMB.1.raw
  modified_base (533)..(533): a, c, t, g, unknown or other
  misc_feature (533)..(533): n is a, c, g, or t
tcagagtacgctatcacgaccggtgctcgatttagctcgatatagttgggtctgggagaggacgcccccgccctgggtttcccaggtgttctctatttggtgatcagcactgcacacagaagagtcatgacgggtagtttgggctgagtcgttgggttttccttgttgtctttaagttttaaaggtcgtacgtaggtgtaggtaggtgacgaggtcgtgggtcggtggtcgggtaggggggtacgtcgtttcggtacccgacggtcccggggttcgggggggttccctaggaaccgtacccgttccgttcccgttggtacgccgtacgtccgttacgtaggtaccttaccgttaaccgtttctaagtttatttagtctacgttagtcgaccgtcggtccggggtacccacgcggtccgtaacgggaggggaacgtcgagtaactcgtgtacgtacggtaaggttaagtaacgtaagtaacgtacgaagtaaataatattaattactatacgacttaaacgtgtaggacgagtntaactacgtcatcgtaccgaagtaacggaacaactaacaacgacgtactacgttatactacgttaagtacggcgacgtcgtacgagtaacggtacgacgacgtacggacgttacgtagttaaccggtagttacggtacggggtaagggtacggggtacggtaaacgggttacgggtaacgggttaaacggttacggggttacggggttaacccggggtaggtaacccggggggtaccggtaaccggggg

SEQ ID NO: 267561 - DNA, 905 bp, Homo sapiens
  misc_feature: GYAE6OF01BFXO5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttaagtttttaaaggtgtccagtgtggaggtgcagcgtgggtggagttcggtgggggacgtcgttgggtccgaggtccggttggggggtccctggacgtaccttcctccgttgtcgcgacggtccttcgtggtaacttcctacccgtttctaaggtttattttatcggtacttagtcgccgtacggttccggggtcccgccgacgggtccgtaccgggaaagggggtaacgggtaccgttaagggtaactttaacggttcgttacgttacggtaacggtttaaagtttaacgtaaaaggttaacgtaggtaaacgtaaaagtaaacttaagttaatttaagtttaacgtacgtaaccctaaaacggttcgttaaagggtaacgggaacggtacgtaagttaaccttaccgaacccttaaccgtacccgtaaccgggtaaacgggtaaccttaaaccgttaaaccgaaacgtaacccgtaccgttaaccgttaagttaacttaccgttaacgtaagggtccggtacctaacggtaccgtaaggacggtaccgtacggtaacggaccgggtaacgtccgggtaacttaggtttaaacgttaaccggtttagggttacggggttaagggaacgggtaaggggtaacccggggtaaagggtttaaaccgggttacggggttaaacccggggtttaaggggggttacccggggttaacgggggtacccggggttaaacccggggg

SEQ ID NO: 267562 - DNA, 852 bp, Homo sapiens
  misc_feature: GYAE6OF01DM3CX.28.57.F02.1.454.CMB.1.raw
tcagagtacgctatcacgaccggtgctcgatttagctcgatatagttgggtctgggagaggacgcccccgccgtgggtttcccaggtgttctctatttggtgatcagcactgcacacagaagagtcatggacggtagttcgggctggtagtcgtttgggttttccttggttgtacttttaaaggtttttaaacggcgtaccgtaggttggtaggagggttgacgaggtcggttaggggtagggtacggttcgggttagggggacgtcggttcggtaccgcgggtccgggtcgggggtcctaggtacgtaccttcgtccgtgcgcgtcgtcctacgtgtacttacctctactaagttattcgtagctacgtacgtcgtaccggtccgggtccacggtcgtacgggtaacggaaggggtaaccgttgtaagttaactcggtacgttacggtacgttaaaggttaagtaacggtaaattaggaacgttaaactaaaacttaagtagttaaacttagttacgaactaaccgtaacgtacgggtacggaagtacggtagtaacttccttaaccgaacgttcctaaacccggtaggggtaaaacctacctaaaccggtaaaccgtaaaggacccttacggttacttaacgttacttaacccggggtaagtaacgtcggaaccgtcggttaagacgggaagttaccggacgtaggggaaccccttaggttaccttagggttactaaacggttcggtaacgggggtgggtaacgaacggggtaacgtaccgggggttaaatttaaacgggtccgggttaagggggttggggacccggggtaggttacccgtaccgggggg

SEQ ID NO: 267563 - DNA, 625 bp, Homo sapiens
  misc_feature: GYAE6OF01BU9XS.28.57.F02.1.454.CMB.1.raw
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagccccgccctgggtttcccaggtgttctcagtttggtgatcagcactgcacacagaagagtcatgacggagtttgggctgagctgggtttccttgttgctattttaaggtgtccagtgtgaggtgcagcgtggtggagtcgtgggggagcttggtccagccgtgggggtcctgagactctcctgtgcagtcctcgtggacttcacgttcaggttatttacnggcctatgctacgtgggtccncaggctaccgagggaacggactggaatagtgtctcaggtattacgaagtaatggaacgaataacattaatagttactgaactaactcgtaggagtaagggcaagtactcgaacacgtcgtaaccgaggtaactaacgttaccaaacgtacgaccgtacgtacgtacttcgtaacgaagtcgggacacggtcgttacggaagttcgacgttacgaacgggaccgtaacggccgttagtacgttaacgttagtaccgggttaggaagggtaaccggaggtaaccggtagttaccggagttagggttcggcgggtacgacgggg

SEQ ID NO: 267564 - DNA, 652 bp, Homo sapiens
  misc_feature: GYAE6OF01D6MIF.28.57.F02.1.454.CMB.1.raw
  modified_base (183)..(183): a, c, t, g, unknown or other
  misc_feature (183)..(183): n is a, c, g, or t
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtgctattttaagtgtcagtgtgagtgcngctggtgngtcgtggggngtcttggtccncgtccggtcgggggtccctggacgtcctcctccgttggcgcacggtcctcgtagtacttcctaccttagtacgtttaatttcgtcgtctaactcgtacctacggtccgggtcccgcgacggtccggtaaccgggaaggggaacggtaccgtaaggtaattagttcggtacctagttagttaaagttaaggaagttaagtacgaaccgtaaaattaacattaacgtaacttaacagtaactaactacgtggaagaacgtactaagtactacctactagttaccccagggaaactactaaccgttaacaacaacgtgttaactcgtttatacgtaacaggtacgcacgtgaacgagtcgtagagacgacgtcgattcgtaatcgtaggtacggtgagggtagacggagtacgtaggacgttaggggtcgcggaaggtccggg

SEQ ID NO: 267565 - DNA, 829 bp, Homo sapiens
  misc_feature: GYAE6OF01CD6BT.28.57.F02.1.454.CMB.1.raw
  modified_base (305)..(305): a, c, t, g, unknown or other
  misc_feature (305)..(305): n is a, c, g, or t
  modified_base (811)..(811): a, c, t, g, unknown or other
  misc_feature (811)..(811): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagcgtggttctgtagctatttaagtgtcagtgtgaggtgcagcgtggtggagtcgtgggggagcttggtccagccgtgggggtccctgagctctccgtgtcgcagcctcgtggtacttccaccttcagttatttatgacttagtcgcgtacgttcggggtcccncgtaggtccgtccggaagggggtaacggtaccgtagggtaaacttagttcgttacgttacgtaaggttaacgttaaggtaaaaggttaagttacggaaaccggtaaaagttaaaccgtaatttaaagtttaactttaaggtacgtaaaccttaaaaccttccggggggttacgttaagggtaaacggggactaacgggttaaccgtttacccaaacccgtttacgttaacccggttaacccgggaaacggggttaaaccctaaacgggtttaacccaaaaacgggtacccaaaccgggtttcccttaaggttaaccctttaccgttaaacggtaaaaccggggtttcggggaaaccctacggggtttcccctaagggaaacgggttccgaacgttacgggaaccggtacgtaccggtacgttaggtaccttaggttaccgtggggtagggaaaggttacgggacgtaacggtagggttaacgggtaacggttaggggtttaccggngggggacccggtaagggg

SEQ ID NO: 267566 - DNA, 908 bp, Homo sapiens
  misc_feature: GYAE6OF01BE1YQ.28.57.F02.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (256)..(256): a, c, t, g, unknown or other
  misc_feature (256)..(256): n is a, c, g, or t
  modified_base (435)..(435): a, c, t, g, unknown or other
  misc_feature (435)..(435): n is a, c, g, or t
  modified_base (784)..(784): a, c, t, g, unknown or other
  misc_feature (784)..(784): n is a, c, g, or t
tcagagtacgctatcacgaccggtgctcgatttagctcgatatagtttgggtctgggagaggagcccccgccctgggtttcccaggtgttctcatttggtgatcagcactgcacacagaagagtcagtgacgggtgtttgggactgagcgttggtttcgtgttaggcttattttaaggntctagtgtgagtncgngtgtggtggacgttcggagggggngtccgtttggaccacggtcccgggttgggggtacccngggtaacgtccttccgttccgtagcgacgtcggtcccttgtaacgtaccttcctaccgtttaagtacggtttatttagtacggttcttacgtcgtacccggtcggttcgggtcccccgtacgggaaccggcccggttaaccggggaaagggggttacgggaacgttaggtaaaacgttnttacgggttaaccgtagttaaaggttaaagttaaacggtaaacgtttacgaagtaaaccgttaaaataaagttattaaattttaaggtacgttaacctaacggttaagttaaccgttagggtaaccggaaaacggtcgttaaacgtaacctttacccgaacccttacgtttaaacccggaaccggtaaaccggtaacctaaaacccgttaaaccgaaaaccgtaacggttaacccgttaacttaccgtttaaatttaccgttaaaccggaacggttaaccggtaacggttaaacgccgttaacgggaaacgtccgtaaacggggttagaaccgggtacttaaaccgggngtttaaaccggtaagttttaccgttaggggttggaaacggggtggtaaaggggtcgggttaaagggtacggttaacggggtttacggttagggggtttacccggcgggggtcggtaacccgggg

SEQ ID NO: 267567 - DNA, 691 bp, Homo sapiens
  misc_feature: GYAE6OF01B571N.28.57.F02.1.454.CMB.1.raw
  modified_base (606)..(606): a, c, t, g, unknown or other
  misc_feature (606)..(606): n is a, c, g, or t
  modified_base (676)..(676): a, c, t, g, unknown or other
  misc_feature (676)..(676): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagctggtggagtcgtgggggagcgttggtccagccgtgggggtccctgagactctcctgtgcagcctctggattccaccttcagttatttatgtcttatcgctacgtcgggtcccgccgaggccgtccgaaggggaacgggacgtaggtaatagtgtctacgtaaggttaattaagtaaacgtaatacgaagtaaataaactaattaattaattaagtacgaactaaaaccgttcgttaggtaggtaaacgggactaacggtaacttacccgaacctaacgttacccgtacccggaaacgggtaaacctaaaccgtttaacccgaaaaccggaacctaccggtacgttacgtacttacttaacgaaagtcgggacaacgtccgtaggacgacgtcgtaggacgtacgacgtnttagtattagtacggtgggtagggaacggtaggaggacggttaaggtagggtaacggtaggggttcgggnggggaccggtacggg

SEQ ID NO: 267568 - DNA, 784 bp, Homo sapiens
  misc_feature: GYAE6OF01EUA7E.28.57.F02.1.454.CMB.1.raw
  modified_base (394)..(394): a, c, t, g, unknown or other
  misc_feature (394)..(394): n is a, c, g, or t
  modified_base (634)..(634): a, c, t, g, unknown or other
  misc_feature (634)..(634): n is a, c, g, or t
tcagagtacgctatcacgaccggtgctcgatttagctcgatatagttgggtctgggagaggagcccccgccctgggtttcccaggtgttatcatttggtgatcagcactgcacacagaagagtcatggacggtagtttgggctggagtcgttgggtttttcctgttgtacttaagtttttaaagggtgtaccaggttggtggagggttcgcaggcgttgggtggaggtcgggtgggggacggtcgtttacgggccagggtcccgggttcggggggtccctaggaccgtaccttcgtccgtgtcgccgtacgtccctggttaggtaccttcccgttaacccttacgtaagttttaattcggtgtacttagtcgaccttccgggtcgggtccccgnggtacggacccggttacggggaaggggacgtacggtagtaatgttcgtacgtacgttaggttaaataacggaagttacgaaggaactaaaatactaattaataacttagaccgtaactaacgtgtaacggtaggacgatacgtctaccactacgtcgtaccgtaacggacctaactaccgaaacgaccgtacgttaccgtagttacttacctaaggacggttacggaactcgacgtacgngtacgtacgaggaacggaccgtagtacggttaattaagttacggtacggttagggtaaccgggtaaggtaccgggaagggttaaggttaacgggggtaaggtttaccggggttaaggggttaccgggggtcggggccggttaaccggggg

SEQ ID NO: 267569 - DNA, 876 bp, Homo sapiens
  misc_feature: GYAE6OF01B3C5E.28.57.F02.1.454.CMB.1.raw
  modified_base (228)..(228): a, c, t, g, unknown or other
  misc_feature (228)..(228): n is a, c, g, or t
  modified_base (593)..(593): a, c, t, g, unknown or other
  misc_feature (593)..(593): n is a, c, g, or t
tcagagtacgctatcacgaccggtgctcgatttagctcgatatagttgggtctgggagaggagcccccgccctgggtttcccagggtgttctctatttggtgatcagcactgcacacagaagagtcagtcgacgggtaggtttgggctgaggtcgttcggggttttccttgttacggtctttaagtttttaaaggtcgtcctagtgtggagtgctggcgtgggtcggnggttcgggtggggcggtcgttcggtaccgacggccgggttcggggggtacctacggtacgtccttccgtccgttggccgacgaccggttccttcggtacggttaacctttaccgtaccccgttttaataggtttttaatttaaggttctaaccggttacgttcggaaccgtttaccgggttaccccggggtccccgaccggtaaccggggtccgtaccggggaaacggggtaacggtaaccgttaggtaacgttacggttcgtaacggttacggttaaagttaaaggtttaagtaacggttaaagtcggtaaaacgtaaaccttaaaggtaattaaaacttgtaagtaaccggtaaccttaacgngtaaaggttgaaacggtactacgttactactactacgtaccgtacgtaccggtaaactacgtaacaaacgtgaccgtattacgtattaccgaacgtacggtcgaacgtccggagttaacggaggtacggtacgacgggtaaccggtacggactacgggttaccttaaggttaccgtagggttaccgggttaggaccgggttaagggtacgggtaaacgggttacggtaaaccggggttacgggttaagggggtaccccgggtggggtaaccccgggtaggggg

SEQ ID NO: 267570 - DNA, 971 bp, Homo sapiens
  misc_feature: GYAE6OF01EX0D7.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatgacggagtttgggctgagtcgttgggttttccttgttgtactttaagtttttaaaggtcgtactagttggtggtaggtgacgagtcgtgggtaggtacggttcgggtagggggtacggtcgtttcgggcccgtacgggtcccgggttccggggggttccctaggtaacgtaccttccttccggttggtcgcccgtacgtcccgttaggttacggttaaccttcctaacccgttttcgtaaggtttaattttgtcgtacttagtcggtaacccgttcgggttcccgggtacccggtacccgtacggggtaccccgtaaccggggtaaaacggggggaaacggggttaacccggtaagggtaacgttaacggtttcgttaccggttaacgggtttaaaggttttaaaagtaaaacgggttaaacggttaacggtaacggttaaaacgtaaaacttaaaacttaagtttaaacgttttaaatttaacggtaacgtaaaaccgtttaaaacccggttaggtttacggggtaaaaaggggacggggttaaaccgttaaacggtttacccgttaaccccgtaaacccgttaccgtttaacccgtaaccggggtaaaacggttaaaccctaaacgttaaacccggaaaaccgtaaccgtaccggttaccgttaagtttacctacgttaaacggtagtccgggactacgtacgtacggagaccggtcgtaaggacgggtaccgtcggtaacttagttaaccgttagggtacgttaggggaaggcgggaacggtaggtacggttaaacgggtagggttaacggttacggggtcgggtgggaaccggtcgggg

SEQ ID NO: 267571 - DNA, 589 bp, Homo sapiens
  misc_feature: GYAE6OF01AFO2N.28.57.F02.1.454.CMB.1.raw
  modified_base (337)..(337): a, c, t, g, unknown or other
  misc_feature (337)..(337): n is a, c, g, or t
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccagccgtggggggtccctggagactctcctgtgcagcctctggattcacctttcagttatttatgctatgcacgtgggtcccgccaggcctccgaggggaacgggctaggaatntgtctcgaggttattagaagtatgacaatacatatatatgacaaactntgtgaggcagactcacatcnccgaggacaattaccaagacacgtctgtacttcttacaagtcgggacacgtcctaggagacgtcgtaggaacggaccgacggtctagttagtagtttacggtgggtagggggaaggtagggacggtaacgggttaagttacgggtaacggttaggggttgggtcgggggaccggtaacgggggg

SEQ ID NO: 267572 - DNA, 748 bp, Homo sapiens
  misc_feature: GYAE6OF01AKSSI.28.57.F02.1.454.CMB.1.raw
  modified_base (495)..(495): a, c, t, g, unknown or other
  misc_feature (495)..(495): n is a, c, g, or t
  modified_base (584)..(584): a, c, t, g, unknown or other
  misc_feature (584)..(584): n is a, c, g, or t
  modified_base (592)..(592): a, c, t, g, unknown or other
  misc_feature (592)..(592): n is a, c, g, or t
  modified_base (627)..(627): a, c, t, g, unknown or other
  misc_feature (627)..(627): n is a, c, g, or t
  modified_base (722)..(722): a, c, t, g, unknown or other
  misc_feature (722)..(722): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttcctgttgcttatttttaaaggtgtccagtgtgaggtgcagctggtggagtcgtgggggagtcttggtccaggtccgtggggggtccctggacgtaccgtcctcctgtcgcacggtccttctggtcttccacctttcaagtttactttactgtccttagtcgaccgtaccggtcggtcccgccgtacggtcctaccggaacggggacggtacgtggtaaacttacgtcggtactacgtaaggttaacgttaaggaaacgttaggtacgaacgtaaaataacgtaattaattaatttaacgacgtaacctaatcgtaggtaggaggtacgacgttactaaccnctaccttacgacccgtagggaaacccttaacgtaccgaaaacgaaccacgtacgttacgtaacgttacccttagaaagtcgggtaaccngtacccgnggtagaacttcgggagacccgggtactaaccgggnttaagggtaaaccttaaggtttacggaggggtagggtaaacggtgggaaacggttaagggtaaacgggtttacgggtaacggttttaacgggggnggtacccggggggtcccgtaaggggg

SEQ ID NO: 267573 - DNA, 827 bp, Homo sapiens
  misc_feature: GYAE6OF01AYFB1.28.57.F02.1.454.CMB.1.raw
  modified_base (194)..(194): a, c, t, g, unknown or other
  misc_feature (194)..(194): n is a, c, g, or t
  modified_base (245)..(245): a, c, t, g, unknown or other
  misc_feature (245)..(245): n is a, c, g, or t
  modified_base (653)..(653): a, c, t, g, unknown or other
  misc_feature (653)..(653): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggagtttgggctgagcttgggttttccttgtgcttaatttttaaaggtcgtccagtgtgaggtncagcgtggtggagtcgtgggggagtcttggtccacggtccgtgggggtccngagtacctctcctgtgctacgcctgttcggacttaccacctttcagtttaactttagcggtaccttagtcggacccgtacggttaccggggtccccgaccggaggtacccttacccggggaaaggggtaacgggggttacctaaggggttaattaccggttacgtcctaacggttaaagggttactttaaaaggaacggtttaaatcgggtaaaccgtaaaataaacttaagttaacgtttaacgttacgacggtaaccctaaacgttcgttacggtaagggaaacggcgtaaaccgtcttaaccccgaagtaccctccggtaaccggtacggtaaaccctaacgttaacccgaaacgtacccgtacggtcctaacgtttacctacttaaccggaaggttccgggacnccggtacgtaggaacgttccgttacgtacgggactacccggtgtacgttagtaaacgtttacggtacgggtttgggaacggggtaagttacggggaacgggtttagttaagggtttaacggggttaaaccgggttggggggttacggtacccggggggtacggtaacccggggg

SEQ ID NO: 267574 - DNA, 863 bp, Homo sapiens
  misc_feature: GYAE6OF01DL41B.28.57.F02.1.454.CMB.1.raw
  modified_base (741)..(741): a, c, t, g, unknown or other
  misc_feature (741)..(741): n is a, c, g, or t
tcagagtacgctatcacgaccggtgctcgatttagctcgatatagttgggtctgggagaggacgcccccgccctgggtttcccaggtgttctctatttggtgatcagcactgcacacaagaagagtcatggacggtaggtttgggctggacggtcgttgggttttccttggttgtactttaagtttttaaaagggtgtaccgtaggttgtaggtagggtgcgaggtcgtgggtgggaggttcgggtgggggacggtcgttcgggtccgacgggtccggtcggggggtccctaggaacgtacttcgtccgtggtacggctcgtcctcgtaggtacttccgtaccttagtaagtttatttaatgtacttacgcgtaaccgtacggtccggggtacccgaccggaggtaccccgaccggaaggggtaacggtacgtaaggtaaactcggtcgttaccgtacggtaaaggttaagtaaaggtaaagtaacgtacggtaaacctaaaattaaacgtaatttaagttaacgttaataacggtaacttaaaccgttagtaaggtaacgggaaacgtacgtaacgtaccgtaactacctaccgtaacgtaaccgtaacgggtaaactaaaccgtaacgaaaccgtaaccgtaccggtatacgtttacgtaacgtttaaagaaccgggtacgacgtaacgtaccgggtaagaccgggtacgtacggaaggaccgggacgttaaccgggtnttaaccgtaagttaacgttacggggtaacggaggggtacgaaaggggtccggtaaaagggttaacgggttaaccgggttaagggtttagggggaccgggttaccgggaagggttaccccggg

SEQ ID NO: 267575 - DNA, 562 bp, Homo sapiens
  misc_feature: GYAE6OF01DQZ0B.28.57.F02.1.454.CMB.1.raw
  modified_base (421)..(421): a, c, t, g, unknown or other
  misc_feature (421)..(421): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgcaggctccgaggggaagggactgggaatatgtctcaggtattagaagtaatgacgaataacatatattatgctaaactctagtgaagggcagattcacatctccagggacaattccaagaacncgctgactcttacaattgggactagccctaggagaggctggaagggacacggtcctagttacgtattaccgtaggttgggggagaggggtagcgggtaaatttgggaaacgttaggggtttcggtagggggtccgaggggg

SEQ ID NO: 267576 - DNA, 847 bp, Homo sapiens
  misc_feature: GYAE6OF01E0TVW.28.57.F02.1.454.CMB.1.raw
  modified_base (236)..(236): a, c, t, g, unknown or other
  misc_feature (236)..(236): n is a, c, g, or t
tcagagtacgctatcacgaccggtgctcgatttagctcgatataggttgggtctgggagaggagcccccgcccctgggtttcccgaggtgttctcactttggtgatcagcacttgcacacagaagagtcactgacggtagtttggggctggagtcgttgggtttttccttgttagtcttatttttaaaggtgtccagttgtgtaggtgcgaggacgtggtcggacgtcgtgggggngcgttggccaggccgtgggggtccctgacgactcgtctgtcgcacgcctcgtggtacttccgaccttcgacgttactttatacgtcttaagtcgtaccgtaccggttccgggtaccccaccggtacgggtcccgttaaccccgggaaaggggggtaacgggtaccgtagggtaaaccttaggttccgtttaccgtacggtaagggtttaaagttaaacgggtaaaggttacgtacggtaaccgtaaaacttaaacgtaactttaaagtttaacttttaacgtacgtaaaccttaaaaccgttcgtaggtaacgggaaacggtctaaacggttaccttacccgaacgttaaccttccggttaaccgaaaggtttaaacctaacgttaacccgaaaacgtacctaccgttacgttagttaaccgttacgtttaacggaacgttcgggaaccttacggtacccggtaggaacgtacgtaggtaacggaacggtaaccgtacggaacgtttgttaaaccgttacggttacggtacggggtaggaaacggtacgggtagttaaccggttagtttacgggtaacggtttaggggtacgggtcggggacggtacgggg

SEQ ID NO: 267577 - DNA, 760 bp, Homo sapiens
  misc_feature: GYAE6OF01AI7ER.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaggtgtcctagtgtgaggtgcagcgtgggtgggagtcggtggggggaggtcgttcgggtccaggtccggttggggggtccctggacgtactccgtcctgtcgcacgcctcgtggtacttcctacctttcgtaagttattttagtcgtacttagtcgcctacggtcgggtcccgccgaggtccgtccggaaagggggaacgggtacgtaggtaaacttgtcgttcctacgtaaggttaacttaaggtaaagttagtcggaacgtaaaactaactaagttaattatttaagtacgtaactaaacttcgtaggtacggaaggtacagtacttaccacttatccgtaacggtaacgtaacctaacttaaccaaacgtacctaacggtccgttagttaaccttccgttaaacgtacggtcggtaccgacgtccgtaaggacgtaccgtacggtaggaccggtacgtacccggtagttattaaacgttagttccggtaggggaggggtaagggagggtaacggtacgggtaacgggttaacgggttacggggtttagggggtccggggttacgggggcggttaaaccgggggg

SEQ ID NO: 267578 - DNA, 836 bp, Homo sapiens
  misc_feature: GYAE6OF01COKA3.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatggacggtagtttgggctgagtcgttgggttttccttgttgtcttaagtttttaaaggtgtcctagtgtggaggtgcagcgtgggtggtagtcggtggggggaggtcgttcggtccgaggtcccggttcgggggggtcccctggacgtacctcctcctggtcgcgacgtcctcgtggtacttccaccttcgtagttatttatgtcttatcgctacggtcgggtccaccgaggtcctaccgggaaggggaacggtacctagggtaaatagttcgttactacgtaaggttaacgttaaaggtaattaacgtgaacggtaaaataaacgtaatttaattaagtttacgtacgtaaacccgtaaacttcgttaaggtaacgggtaaacgggactaacggttacttaacccgaacccgttaacttacccggtaaccggtaaaccgggtaaactaaaccgttaaccggaaaacgtaacccgtaacgtcttaaccggtactttaccgttaaaacgtaaaggtccgggtaacgccgttaacccggtaggtaaaccgtacggtaacgggttacggaaacgggacccgtaacgggttcttaacgttaagtacgtttaacggggttgggtaacgggggaaggtaacgggaacggtaacgggttaaggttacggggttaaacggttggggggtttaacggccgggggtacggtaaccggggg

SEQ ID NO: 267579 - DNA, 819 bp, Homo sapiens
  misc_feature: GYAE6OF01CZHYM.28.57.F02.1.454.CMB.1.raw
  modified_base (188)..(188): a, c, t, g, unknown or other
  misc_feature (188)..(188): n is a, c, g, or t
  modified_base (461)..(461): a, c, t, g, unknown or other
  misc_feature (461)..(461): n is a, c, g, or t
  modified_base (488)..(488): a, c, t, g, unknown or other
  misc_feature (488)..(488): n is a, c, g, or t
  modified_base (801)..(801): a, c, t, g, unknown or other
  misc_feature (801)..(801): n is a, c, g, or t
tcagagtacgctatcacgaccggtgctcgatttagctcgatatagttgggtctgggagaggacgccccccgccctgggtttcccaggtgttctcatttggtgatcagcactgcacacagaagagtcatggacggtagtttgggctggagtcttgggttttccttgttgtactttaagtttttaaaggngtccaggtgtggaggtgcgaggcgttgggtaggaggttcgggtggggggagttccgttcgggtcccgaggtcccgggttcggggggttcccaggtaacgtccttcgtccgttggtcgacctcggtccttcgtaggtaactttccgtaccttataaggttttacttagtcgtcttatcgtacctacgttccgggtaccccgacgacggttccgaccggaaggggaacggactaaggtattagtgtacctgtaaggttaattaacgaagttaagngaaacgtaaataatattatataggtanaaacgtattcgtaggtaagcgggataagtacttacccgactacgtaccgtaaccggaacggttaactaacgtaacgtaaacgaccggttaacctaggttaaccttaacttacccggtttaaagaacgggtttacgggacccgtaacggtacggtaacgagggtaaacgtgtacgggttaacgaaccggttccggtaattaaccggtaagtttaacaaggggttaggggacgggtaaagggtaccggaagggtttaccggaaaggtttaggggggttaacccgggttaaggggggtttcgggaaaccccggggnggggtttaaaccccgggg

SEQ ID NO: 267580 - DNA, 768 bp, Homo sapiens
  misc_feature: GYAE6OF01EEH6U.28.57.F02.1.454.CMB.1.raw
  modified_base (585)..(585): a, c, t, g, unknown or other
  misc_feature (585)..(585): n is a, c, g, or t
tcagagtacgctatcacgaccggtgctcgatttagctcgatatagttgggtctgggagaggagccccccgccctgggtttccccaggtgttctctatttggtgatcagcactgcacacagaagagtcatgacgggtagtttgggctggagtcgttgggtttttccttgttgtactttaagtttttaaaggtgtccagtgtggaggtgcagtcgtgggtggaggtcggtgggggagtcgttcggtccgaggtccggtcgggggtccctgacgtacctctcctgtcgcacgtcctgtgtacttcctacctttacgtagttatttatcgtctatcgccgtacggtccgggtcccgaccgacgggtcccgtaacgggaacggggtaaggggtactaggtaacttacgttacggttactacggtaaggtttaagttaaaggtaaacgttagtaacggtaaacgtaaaacttaataagttaagtttaatttaacgacgtaactaaaacgtcggttaaggtaagggaaacggtactaagtactacccgaacgtactaccgacgtaaacggacttaaactaccgaaactacgngtacttagtactagtaacgtaagtcgacgcgtacgtaggaatcgtacgagggacgtaccgtacggtagtaagtttaccgtaagttgggacgggttaagggaacggtaacgggtaaggtacgggtttaaagtaccgggggttaaaggttgggggttacgggtcccgggacggggttaacccggg

SEQ ID NO: 267581 - DNA, 758 bp, Homo sapiens
  misc_feature: GYAE6OF01C737Y.28.57.F02.1.454.CMB.1.raw
  modified_base (182)..(182): a, c, t, g, unknown or other
  misc_feature (182)..(182): n is a, c, g, or t
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcgttgggttttccttgttgcttaattttaaaggtntccagtgtgaggtgcgagcgtggtggagtcgtgggggagtcgttggtccagccgtgggggtccctggagtactctctgtcgagtacgtcctcgtggtacttcgtaaccttgaacgttattttancgtactagtacacgtacggtcgggtcccgaccgtacggtactaccggaaggggaacggtaacgtaggaatcgtgtctacgtaggttaagtaaggtaacgtaagtgaaacgtaaagttaaactaattaagtaactttaagacggtaacctaaacgttactggtaaccgggtaaggtacaacggtaacttacccgaactacgtacgtaccgaaagggtaactaactaaacgaaacgacgtaccgtctagtaacttcgttaaagaaacggtcggaccgaataccggtaagtacgaacggttccgaaggaccgtacggtaacgtagtaacgttacgttaacgttacggtaagggggtaaggtacggggtaaacgggaaacggttagggtaaaccggtttaaagggtaaccggggtttaggggtttaaccgggcgggggtaacccgtaaacgggggg

SEQ ID NO: 267582 - DNA, 780 bp, Homo sapiens
  misc_feature: GYAE6OF01DLB7M.28.57.F02.1.454.CMB.1.raw
  modified_base (566)..(566): a, c, t, g, unknown or other
  misc_feature (566)..(566): n is a, c, g, or t
tcagagtacgctatcacgaccggtgctcgatttagctcgatatagttgggtctgggagaggagcccccgccctgggtttcccaggtgttctcatttggtgatcagcactgcacacgagaagagtcagtgacgggtagtttgggctgagtcgttgggttttccttgttgtacttaagtttttaaggctacgagtggtgaggtgcgtagtcgtgggtaggtaggttcgggtagggggtagttccggtttggtacccgcgggtccgggtcgggggttaccctaggtacgtccttccgtccgtgtcgctacgtccgttagtcgttacttaccgtacctttagtaaggtttatttacgtcgtacgttacgtcgtaccggttaccggttccggggttaccccgacggtaaccgtcccggttaaccgggaaagggggtacgtaacggttaacggtaattagttaccgggtctaacggttaaggtaagttaacgtaaaagggttactaaacgtaagtaaaactaacttagttaattaagtactacgaaacgttactggtaggtaaggaacggtntaacgtacctacactacgtaccgaagagtaactacgttaacgaaacgacggtactacttacgtaataccgtaaagacggtcgacgtaccgtagagtacgtacgtcgaggtacgacgtagtcgttaataggttacgtagggtaggtaaggcggtaaggaaggttcggtaacggttagggttcgggtaggggtcggtacgggaacggttaccgggg

SEQ ID NO: 267583 - DNA, 818 bp, Homo sapiens
  misc_feature: GYAE6OF01DR0LK.28.57.F02.1.454.CMB.1.raw
  modified_base (807)..(807): a, c, t, g, unknown or other
  misc_feature (807)..(807): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacgggtagtttgggctgagtcgttgggttttccttgttgtcttaagtttttaaaggtgtccagttgtaggaggtgcgaggtcgtgggtacggtggtcggtggggggtacggtcgtttcgggtaccgacggtccgggttccgggggggttccctaggtacgtaacttcctccgttgtacgcgtacgtccgtacgttggtacttacctaccgttatagtttatttatggtactagtgtccgtacggtcgggtacccgcgacggtcgtaccggaaggggaacggtacgtaggaattcgttacgtccttaacggtaagttaaaggttaagtaaagttaaagtgtaaaaccgtaaaatttaaacctaaattaagtttaagttaaacggttaacgtaacttaaaaccgttccggtttaagggaaacggtaaaacggacggttaacgttaacgtttaccaaacccgttaaccgttacccgtaaccgggaaacggtaaacccttaaagttaaccccgaaaagaacccgtaacgtacgttacgttaacttaaccgttaagtaaacggtcggtacgacgtaacgcggtaagtacggacgttaggaacggtaccggaccgttagtagttactaagttcggtagggtaggtaacggagacggtaagtagggtacgtaggtaggggttcggnggacggtcggg

SEQ ID NO: 267584 - DNA, 861 bp, Homo sapiens
  misc_feature: GYAE6OF01BQ9EA.28.57.F02.1.454.CMB.1.raw
  modified_base (708)..(708): a, c, t, g, unknown or other
  misc_feature (708)..(708): n is a, c, g, or t
tcagagtacgctatcacgaccggtgctcgatttagctcgatatagttgggtctgggagaggagcccccgccctgggtttcccaggtgttcgtctatttggtgatcagcactgcacacagaagagtcatgacgggtagtttgggctgagtcgttgggttttccttgtttgtcttaagtttttaaaggtgtcctagtggtgagggtcgcagtcgtgggtggaggtcggtgggggagtcgttggtcccgaggccggtcggggggtccctaggacgtacctccgtccgtggtcgcgacgtcctagtcggtacttccctacccgtttgtaagtttaatttacgtaggtacctagttcggaccgttaacggtccgggggttacccccggacccgtaccggggtacccgttaacccggggaagggggaaaccggggttaacggtaaggtaaagttaggtcggtttactaacgggtaaggttaagtttaaaaggtaaaaggtaagttacggaaacgtaaaacttaaacgttaaagtttaagttaactttaaagtaaccgtaaaccgttaaaacttccgggtttaaggtaagggtaaaccggacgttacggttaacgtttaccccaacgtaaccgttaccggttaaaccgtaaaccgggtaaaccctaacgttaaacccgaaacgtaacgacgtttacgttatacgtttaccgtaanaacggttcggaactcgtaccgtaggagtcggtaacgtgtaacggacgtaccggtcttaagttacgttaagtacggtggtaagggaggacggtaggtacgggttaacgtttcgggtaacgggtaggggtaccggggtggaaaccgggtaccggg

SEQ ID NO: 267585 - DNA, 823 bp, Homo sapiens
  misc_feature: GYAE6OF01CHI14.28.57.F02.1.454.CMB.1.raw
tcagagtacgctatcacgaccggtgctcgatttagctcgatatagttgggtctgggagaggacgccccccgccctgggtttcccaggttgttctctagtttggtgatcagcactgcacacaagaagagtcatgacggtaggtttgggctgagtcgttgggttttccttggttgtctttaagtttttaaaaggtcgtaccgtaggtgtggaggtgcgaggcgtgggtgggagttcggtgggggtagtccgttcgggtccaggtcccgggtcgggggtccctggacgtaccttcctccgtggtcgccacgtcccttcgtggtacttccctaccgttagtaacgttttatttacgtcgtccttagtccgtccgtacggttccgggtcccgccgacggtcccgtaccggaaagggggaacggtacgtaggtaaacttacgtcgtacgtaggtaacggttaattaaacggtaaagtaagtaggaaccgtaaaattaaacgtaataagtttaaattagaacgtaactaaacgttgtacggtaaggtaacgggactagtaacttcccgaactacgtaccgacgaaagtaacaaccgtaactaaacgacctacttacgtacgttactaccgtttaagaacggtacgtcgacgtaacgtcggaaacggtcgaacgttaacggaacgggtacgtaccgggttcttaaggttaagttaacggttcgggtaaggggtgggtaaacggggtacgggttaagggtaaccgggtttaaggttaaaccgggggttaggttaacgggggttgggggtaacccggggtccgggtaacgggg

SEQ ID NO: 267586 - DNA, 706 bp, Homo sapiens
  misc_feature: GYAE6OF01ECHZS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgtcttaatttttaaaggtgtccagtgtgaggtgcagctggtggagtcgtgggggagtcttggtccaggccgtcggggggtccctggagtacctctccgtgtgcagtcctcgtggtacttccaccttctagttatttatgtactatcgactacggtcgggtcccgccgaggccgtacccggaaggggtaaggtacgtaggaattagttcgttctacgtaaggttaacttaaggaaagttaagtagaacgtaaaataacgaattaattaattagtacgtaactaaaccgtcgtagtaggaaggtctaagtactaccaccgtaactcctaccgaacggtaactaaccttaaccgaaacgaaccgtacctacgttattaacttacttaacgtaaggtcggactacgaccgtaggacgtacgtcgtaggaaccggacgacggtacttaggtaattagttacggtaggggttacggaaggtagggaacgtaagggtaaacggtttacggggtaacggttaggggtttcgggacgggaccgggtaacgggg

SEQ ID NO: 267587 - DNA, 893 bp, Homo sapiens
  misc_feature: GYAE6OF01BC3VT.28.57.F02.1.454.CMB.1.raw
tcagagtacgctatcacgaccggtgctcgatttagctcgatatagttgggtctgggagaggagcccccgccctgggtttccccaggtgttctctatttggtgatcagcactgcacacagaagagtcatgacggagtttgggctgagtcttgggttttccttgttgcttaagtttttaaaggtgtcctagtgtgaggtgcgagtcgtggtggacgtcggtgggggacgtcgttggtccgaggtcccggtggggggtccctggacgtacctccgtccgtgtgcgtacgtcccgttcgtggtactttcccgtacctttacgtaaggtttaattttacgtgtacttacgtacggccgttacggttccgggggtaccccgtaccggtacgggcccgttacccggggaagggggtaacgggtacgttaggaactttacgttcggtaacccgtaggtaaggttaagttaaagggtaaacgttaacgtacggaacgtaaaaactataacgttaagttaatttacgtaacggtaacctaaacgttcggttaaggtacgggaaacggtacaacggttacctttaccaaccctaacgtaccggtaacggtaacccgggtaaacctaaccgttaaccgaaacggtacccgtaacgtaccgtttaaccggtaactttcgttaaacggtaaacggtcgggtacccgtaacggtccgtacggaacgggttaccgtacggttaaggaaccggaccggttaacgtaccggtttaagttacggttaacccgttaggtacgggggtaaagggtcggggtaaaggggtaaaccgggttacgggttaaacgggttaaaccggggttacggttaacggggggtacgggttcccggggggaaaggtaccccggggg

SEQ ID NO: 267588 - DNA, 849 bp, Homo sapiens
  misc_feature: GYAE6OF01EZT7I.28.57.F02.1.454.CMB.1.raw
  modified_base (177)..(177): a, c, t, g, unknown or other
  misc_feature (177)..(177): n is a, c, g, or t
  modified_base (816)..(816): a, c, t, g, unknown or other
  misc_feature (816)..(816): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagttttaaggtntccagtgtgaggtgcagctgggtggagtcggtgggggagcgttggtccgaggccggttggggggtccctggacgtaccttctccgtgtgcgagtcccttgtggtattaccctaccgttcgtaagttattttaagtcgtacctagttcgcctacggtccgggtcccgccggtacgggtccctaccgggaaaggggtaacggggtaccgtagggtaattacgtggttaccgtacggtaaggtttacgtaaggtaaattaagtacggtaacgtaaattaaactaagtttaactaattacgtacgtaaccttaaaccgtagttagggtaacggaacgggtaccttaagggtaaccttaccgtaaccctacgttaacccgtacccggaaacgggttaacctaacgttaaccgaaaacgtaaccgtacggttacctaggttaacttaccgttaaactaaacgggtgggaacctaggtacccgttaaggaacggtacgtacgggttaacggaacggtaccggtaaccggtagttaaccgttaaacggtttaaccggtttaccggttagggggtaaaccgggtagggtaaacggggtacggtaaacgggtttaaacggtttacgggggtaaagggttttacgggggnggggttaaccggggaaacccggggttccggggg

SEQ ID NO: 267589 - DNA, 814 bp, Homo sapiens
  misc_feature: GYAE6OF01ALLQW.28.57.F02.1.454.CMB.1.raw
  modified_base (272)..(272): a, c, t, g, unknown or other
  misc_feature (272)..(272): n is a, c, g, or t
  modified_base (664)..(664): a, c, t, g, unknown or other
  misc_feature (664)..(664): n is a, c, g, or t
  modified_base (713)..(713): a, c, t, g, unknown or other
  misc_feature (713)..(713): n is a, c, g, or t
  modified_base (730)..(730): a, c, t, g, unknown or other
  misc_feature (730)..(730): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttaagtttttaaaggtgtccagtgtgaggtgcagctgggtggaggtcggtgggggagtcgttggtccgaggccggttcgggggggtccctggagactccgtcctggtncgagtcctcgtaggtcttccacccgttatagtttacttttagtgtaccttagttcgacctacggttccgggggccccgccgaacggggtcccgtacccgggaaagggggaaaccggggtacgttaagggaaacgttagttacgggttaccttaagggtaagggtttaatttaaaagggtaaagttaacgtacggtaacctaaaataaactaagtttaaaatttatttaacgtaccggaacttaaacttcggttaggtagggaacgggtcgtaaggttaaccctcaccttaacttcggaaccgaagggtaaacctactaacccgaaacaccggttacgccttagttaccttacggttaacgaagtccggggactcggccgtaggaacggtacncggttaacgggaaggacccgtaggtactagtttaagttactttacgggnggggttagggaacgggnggttaaaccggagggtttaaacggggttacggttaaaagggggttcgggggggtttcgggaaacccgggggcgggtaaaccggg

SEQ ID NO: 267590 - DNA, 640 bp, Homo sapiens
  misc_feature: GYAE6OF01C74KU.28.57.F02.1.454.CMB.1.raw
  modified_base (263)..(263): a, c, t, g, unknown or other
  misc_feature (263)..(263): n is a, c, g, or t
  modified_base (381)..(381): a, c, t, g, unknown or other
  misc_feature (381)..(381): n is a, c, g, or t
  modified_base (505)..(505): a, c, t, g, unknown or other
  misc_feature (505)..(505): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggtccagccgtggggggtccctgagactctcctgtgcagcctcgnggattcaccttcagttatttatgctatcgcacgtcgggtcccgccgtacggcctccggaaggggaacgggaccgtgggaatagttcgttctacgtaggtaagtttagaaacgttaagngaacgtaaataaacattaataacttatacgactaaacttctaggtaggaaagggactagtattaccacctagtctaccggaaggtaaccaattaccaaacgaactacgcttagtattccttaanaagtcgggacaagcccggtagagtacgccggttagaacggacgtcgacttagtaacttagttacgtgggagggaggaggacggtacgtaagggttaccggaaaggttggggtacgggtggggtacccgaaagggg

SEQ ID NO: 267591 - DNA, 876 bp, Homo sapiens
  misc_feature: GYAE6OF01BNOHA.28.57.F02.1.454.CMB.1.raw
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagcttgggtttttccttgttgcttatttttaaaggtgtccagtgtgaggtgcagctggtggagtcgtgggggagtcgttggtccaggccgtggggggtcccctggagtacctctccgtgtcgcgagtcctcgtggtacttcctaccgttctagttatttactgtactagttcgactcgtcggggtcccgaccggacggtccgtaccgggaagggggaacgggtaccgtagggtaattacgtcggttacttacggtaaggtttaattaaggtaaagtagtacgaaccgtaaataacgtattattaattagtacgaactaactgtaggtaacggaacgggtntaacggttacttacccgaacccttacgttaccccgtaaccgggtaaacgggtaaaccttaaccttaaccggtaaaaccgtaacccgaaccggttaaccgtttaacgtttaacgttacccgttttaacggaaacggtttacggggaccgtaacggtaccccggttaacggaagggtaccggttaacggttacggggaaccgaccgggtacgggttacttaccggttaaacgtttaaccggtttaggggtacggggttagggggaaacccggggttaaagggggtaaacccgggttaaggggttaaaaccggggtttaaacgggggtttaaccgggggtttaaagggggttcgggggggtttaaacccgggggcccgggggttaaaccggggggg

SEQ ID NO: 267592 - DNA, 829 bp, Homo sapiens
  misc_feature: GYAE6OF01EA18I.28.57.F02.1.454.CMB.1.raw
  modified_base (503)..(503): a, c, t, g, unknown or other
  misc_feature (503)..(503): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcgttgggttttccttgttgtcttaagtttttaaaggtcgtcagtgtgaggtgcagcgtgggtggagtcggtgggggacgtcgttggtccgaggtcccggtcgggggggtccctggacgtaccttctcccgttgtcgcctacgtccttcgtggtacttcctacccttataagtttaattttgtgtacttagttcggcctacggtccggggtcccaccggtacggaccgttacccgggaaggggaacggggtacgtaggtaattacgtgttaccgtagtaaggttaagttaaggaagttagaacggtactaaaatactaaattattagttatacgactaaactgtaggagaacggtanagttactcctacgtactcgtaacggaacgaaactaacgttaaccgaaacgtacctaacgttacgttactacgttaaccttaacgtaaggtccggtacgtaacccggtaccggtaggtacgaaccggttcggtaagggaacccgtacgggtaaccggtttacgttaacggttacgtttaaacggtttacccggggaagggggttaaggggttaaacgggtaaacggggtaccgggttaaaaggggttaacccggggtttaaggggttaaaccgggggttaggggggtttaccggggtaacggggggtaacccggggtaacccggggg

SEQ ID NO: 267593 - DNA, 747 bp, Homo sapiens
  misc_feature: GYAE6OF01CXUEW.28.57.F02.1.454.CMB.1.raw
  modified_base (183)..(183): a, c, t, g, unknown or other
  misc_feature (183)..(183): n is a, c, g, or t
  modified_base (336)..(336): a, c, t, g, unknown or other
  misc_feature (336)..(336): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggngtccagtgtgaggtgcagcgtggtggagttcggtgggggagtcgttggtccgaggtcccggtcggggggtccctaggacgtaccgttccttcctggtcgccgacgtcccttacgtggtaactttccctaacctttacgtaagtttaattttgngtacttagtcgccgtaccggtcgggtccccgacgtacggtcctaccggaaggggaacggtacgtaggtaaattgtaggtccttaggtaaggttaataaggtaacgtaactgaaacgtaaattaataattataactttagacgtaactaaacgttcggaggtaggaaacgctactacttaccacgttactccgtaacgaagtaacctaacgtaaccgaagacctacgtacttagtaccttaacgttaacgaaggtccgatacgccgtaggacgtagacgtagaaccggtcgtaacggttcttaaagttaccgtaggttcgggtaagggtaggtaacggggaaggttaacggtaacgggttaaggtacgggttaaacgggttggggttacggcgggggtacccggtaacgggg

SEQ ID NO: 267594 - DNA, 791 bp, Homo sapiens
  misc_feature: GYAE6OF01BUHF7.28.57.F02.1.454.CMB.1.raw
  modified_base (648)..(648): a, c, t, g, unknown or other
  misc_feature (648)..(648): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtctttaagtttttaaagggtgttcctaggttggtggacggtgcaggtcgtgggtggtaggttcggtggggggaggtcgtttcgggtccgtacgggtccgggttcgggggggtccctaggtacggtaccttccgttccgttggtacggcctacggtcccgttcgttggtactttcctaacctttcgtaagtttatttagtcgtactacgttcggcgtacggttcggggtccccgacggtacggccgtaaccgggaaggggtaacggtagtagggtaatacggttcgtacgtacgtaaggttaacgtaagtaagtacgtagacgtaaataacgtattactattacagtaactaacgttcgtaggtaaggtaggtactaaggtacctacccgtaataccgttaccggaccggtaaggtaaaccttaccgtaaacaaacgtacctacggttacgttaacgttactacgtaaacgtaacggtccgaanacggttaccgagggactacggtacggacgaccggtaccgacgttgttaaacttcggttaaacgttgggtacgggtaggtaacggagggaacggttacggtaaggttggggaaacggtttgggcggtaccggggcggtaacggg

SEQ ID NO: 267595 - DNA, 879 bp, Homo sapiens
  misc_feature: GYAE6OF01CB0AW.28.57.F02.1.454.CMB.1.raw
  modified_base (322)..(322): a, c, t, g, unknown or other
  misc_feature (322)..(322): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctgggtggagtcgtggggggagcgttgggtccagccggtcggggggtccctggagactctcctgtgcagcctcgtgattccaccttcagttatttatgtactatgcgtacgttcggggtaccccnccgacggtcctacccggaaaggggaaacggggtactagggtaaattacgttcggttacctacggtaagggttaactttaaggaaagtttaaactggtaaaccggtaaaatttaaaaccgtaattaatttaactttaaacgtagtaaccctaaaacgtttccgttaagggtaacgggtaaacgggacgtaggtaaactttccgaaaccctagttaaccccgttacccggaaacgggtaaacctaaaccgtttaaaccaaaacgggtaaacctaccggtaacgtttaccgtttaaactttacccgtttaaacgtaaacgggttcccgggggtaactaaccggtaaccccggttagggaaacgggttaacggtcccgggtaaagggtaaccggaacccggtacgggtaacctttaggttaaaacgtttacggtttacgggtacgggttaaggggggaacgggttaacgggggaacggtaaacgggttaaacgggtttacgggtaaaacggggtttggggggtttaccgggtaccggggggtaacccgggtaaccgggggg

SEQ ID NO: 267596 - DNA, 798 bp, Homo sapiens
  misc_feature: GYAE6OF01BWKSM.28.57.F02.1.454.CMB.1.raw
  modified_base (313)..(313): a, c, t, g, unknown or other
  misc_feature (313)..(313): n is a, c, g, or t
  modified_base (601)..(601): a, c, t, g, unknown or other
  misc_feature (601)..(601): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaatttttaaaggtgtccagtgtgaggtgcagctggtggagtcggtgggggagtcgttggtccgaggccggttcggggggtccctggacgtacctcctcccgtgtcgcctacgcccttcgtggtacttccaaccttctagttatttangtctatgccgtacggtcgggtcccgacccgagggtacctaccggaaggggaacggggtacctaggggtaaacttagttcggttctacgttaacgggttaatttaaaggaaacgttaaagtcggtaacgtaaaattaaaacgtaattaacgtaatttaagtcgaactaaacctcgtaggtaacgggaagggtccaagttacgttaccaccgtaacgtcccgtaccggtaaacggtaacctaacgttaacccaaaccgaacgaccgtaccttcgttaacttaccgttaanaaacggtcgacgacgtacgtacggtaagacgtaccgtaggaacggcccggtaaggttacgttacgttaaacttaacggttaccgggtagggtacgggggaacgggaaggggtacgggtaacgggttaaacggtttacgggggtaaacgggtttaggggggtttcggggtaaccgggggttacgggtaacccgggggg

SEQ ID NO: 267597 - DNA, 638 bp, Homo sapiens
  misc_feature: GYAE6OF01A6HK3.28.57.F02.1.454.CMB.1.raw
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (411)..(411): a, c, t, g, unknown or other
  misc_feature (411)..(411): n is a, c, g, or t
  modified_base (558)..(558): a, c, t, g, unknown or other
  misc_feature (558)..(558): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggagcttggtccaggccgtggggggtccctgagactctcctgtgcagcctcnggacttcaccgttcagttatttatgtctatgcacgtcgggtccncgaggcctcgaggggaacggcgtaggactagtgtctcgaggttatagaagtatcgataataactatatattatgactaactgtgtaggaggcagtacttcgactntaccgtcgaaggacctaacgttaccaaaggaacctcgtcgtagttacttccttaacgaaggttcgggacacgtccgtaaggacgtacgtcgtacggaacggaccgacggttcgtagttaagtacgtttaacggtggggttaaagggngggtaaccgggtagggttaaggttacgggtaaacgggtttggggttaggggccggggttaacccgggaggggtacccggg

SEQ ID NO: 267598 - DNA, 741 bp, Homo sapiens
  misc_feature: GYAE6OF01AC13M.28.57.F02.1.454.CMB.1.raw
tcagagtacgctatcacgaccggtgctcgatttagctcgatatagttgggtcgtgggagaggagcccccgccctgggtttccccaggtgttctcatttggtgatcagcacctgcacacagaacgagtcatgacggagtttgggctgagctgggttttccttgtgctattttaaggtgtccagtgtgaggtgcgagcgtggtggagtcgtgggggagtcttggtccacggtccggtcgggggtccctggacacgtctccgtgtgcgagtcctcgtggacttccaccgtttcacgttaatttacgtcgacctagtcgaccgtacgtcggtcccgaccgacggtacctacccggaagggaacggtacgtaggtaattacgtccgttcgtacgtaaggttactaagtaacgtagtacgaacgtaaactaactacttaagtacttagacgtaactaacgttcgtaggtacggaacggtactaacgttaccgtttaccgaacccgttacgtaccccgttaaccgggaaacgggtaacccttaaccgtaaccgtaaaccggaacctacgttaccgttaagttactaccgttaacgtaacgtcggactacgtcgtaggacctggtacgtacgaccgacgtacgtcgttagttaccgtagttaacgggtggtaacggggagtaacggcgggtaacgtaacggttaaccggtacgggttacggggtacggtccggggtacgtaaccggggg

SEQ ID NO: 267599 - DNA, 717 bp, Homo sapiens
  misc_feature: GYAE6OF01A7VAJ.28.57.F02.1.454.CMB.1.raw
  modified_base (568)..(568): a, c, t, g, unknown or other
  misc_feature (568)..(568): n is a, c, g, or t
  modified_base (581)..(581): a, c, t, g, unknown or other
  misc_feature (581)..(581): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggccagccgtcgggggtccctgagtactctcctggtgacgagcctcgtaggtattcctacctttactagttaactttgtcgtacttagtgaccttacggtccggggtccctaccgacgggtcccttacgggaacgggggtaaacggtacgtacggtaaacttagttacgtaccgttacggttaaggttaacgttaacgtaagtagtacgaaccgtaaagtaacaaagttataacttagtacgaaactaacttgtaaggtacggacggtaagtacgtaactaccgtaactacgtcctaacggaacggtaactaacctacgaaacgtacacgtgtagtaactcctaagtaancggactcgtacgngaacgtgtaagacgggtacgaacgacggtagtacgtaaacgttacgttacggtagggttacgggaaggtacggacggtacggttaaagggtcggggtaaggttagggggttcgggaacgggtcgggtaacccgggg

SEQ ID NO: 267600 - DNA, 841 bp, Homo sapiens
  misc_feature: GYAE6OF01CGET6.28.57.F02.1.454.CMB.1.raw
  modified_base (285)..(285): a, c, t, g, unknown or other
  misc_feature (285)..(285): n is a, c, g, or t
  modified_base (339)..(339): a, c, t, g, unknown or other
  misc_feature (339)..(339): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttatttttaaaggtgtcctagtgtgaggtgcagcgtggtggaggtcggtgggggagtcgttggtccaggtccggtcggggggtccctggacgtacttccgtccgtgtcgcacgccttcgngtacttccaccttctagttatttatgcttagtgctacggtcgggtccgacccgnggtaccgtccggaagggggaacgggaccgttagggtaaacttacgttcgttacgttcgtaagggttaaacgtttaaaggaaaaggtttaaggtacgtaaacggtaaaactttaaactaagttaatttaacgttaacgtacaaacccgttaaaacgttcgttaaggtaaggggtaaacggactaaggtaaccttccgtaaaccctacgttacccgtaacccggtaaacggaaaccttaaaccgtaaccgaaaccgaaccgtaaccgttacctaagtttaactaccgtttaaacctaacggttaccgggacgtacgacgtaagacggtacgtacgttacggaaggcccggacggttacgttaacgttacgtttaaagtttacccgggtaggggttaacgggagggtaacggggtaacgggttaaaggggttaaacggtttacgggggtaaacgggtttagggggtttaacgggggtacccgggggtacgggtaaaccccggggg

SEQ ID NO: 267601 - DNA, 704 bp, Homo sapiens
  misc_feature: GYAE6OF01DN391.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtcagtgtgaggtgcagcgtggtggagtcgtgggggaggcttggtccagccgtgggggtccctgacgctcgtcctgtgcagcctcgtggtacttcctaaccttcgaagttatttatgtctatcgctacggtcgggtccgaccgtacggccgtaccggaaggggtaacggacgtaggtaattactggtctacgtaggttaaattacggaaattaacgtgaacgtaaattaaacagtttaattaattacagtaacctaaagttcgtaggtaaggtaacgggactagacttacacctacgtcgtaacgacggtacaaacttaacgaaacgactaacgtcttacgtattactaacgaacggtcgggacaacggtcgtaaggagtacggtactaacgggacggacctaacggtcgttagtaagtttaaccgtgggttaacgggtagggggtaacgaaacggggtaaggtacggttaaagggttcgggttaaagggtttacgggggtacgggttcgggggaccgtaaccggggg

SEQ ID NO: 267602 - DNA, 832 bp, Homo sapiens
  misc_feature: GYAE6OF01CJQAN.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagcgttgggttttccttgttgcttaatttttaaaggtgtcagtgtgaggtgcagcgtggtggagtcggtgggggagtcgttggtccgaggtccggttcggggggtccctggacgtaccttccgtccgtggtcgcgacgccttcgtggtacttccgtaccttacgtaagtttaatttatcgtacttagtcgacctacggttccggggcccgaccgacgggtcctaccgggaagggggaacggtacgtaggtaaattgtacgttcgtagtagggttaacttaaagggtaaacgttaacgtacgaaacgtaaaacttaaaacgtaatttaactttaagtttaacgtacgtaaacccttaaacgtttcgtaaggtacgggaaacgggtaccgtaagtaaccttaccaaacccgtacgttaccccgtaaccgggaaaccggttaaacctaaacgttaaaccgaaaccgtaaccgtaccgttacgttaacgtaacttaccggtttaacgaaacgggttcgggactacggtaccggtaggacgtacgtacggtacggaacggtacgtaaccggtgttaagttacgttaacggttacggtgggtaagggaagggtacgggtaaacgggttaaggttaaggtacggggtttaacgggttaggggggttccgggtacgggggtaccggtaaccggggg

SEQ ID NO: 267603 - DNA, 976 bp, Homo sapiens
  misc_feature: GYAE6OF01BG9PO.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagtagtcatcggacggtagtttgggctggtaggtcgtttggggtttttccttaggttgtctttaagttttttaaagggtcgttaccgtaggttggttaggagggttcgtacgtaggtccgttggggtgggtacggttcgggttacggggggacgttcggttcgggtccgtacgggtccgggttcgggggggtacccctaggtaccgtaccttccgttccgttcggtacgtccgtacggttcccgttacggttacggttactttacccgtaaccgtttacgttaaggtttaattttacgtcgtacgttaacgtcgtaccgtaccgggtcccgggtcccgtaccggtacgggtccccgttaacgggaagggggtaacggtaaccggttaggtaacgtttaccgttcggttaaccgttacggttaaacgggtttaacgttaaacgggtaaaggttaacggtaacgtaaccggttaaaagtaaacctaagtttaacgtttagttaaacggtacgtaaacccgttaaaacgttcgggttaagggtaacgggttaacggtcccttaaagtcgtttaacccaaccgttcgaaccgtaaccgggtaacggtaactaaccgtaaaccggaaagtaccgtaccgttaagttacggttaacttacggttaacgtaagggtcggtaaccgtacggtaccgtaagggtacgtacgtacggtaacggttaccggtacggttaacccgttgtaaacgtttaccgtaacggtttacggtacgggaacgggtaagggtaacgggttaacggtagggttaaacgggtcggtaacggggtttaggtaaccgggggtccggggtaacggtacccggg

SEQ ID NO: 267604 - DNA, 820 bp, Homo sapiens
  misc_feature: GYAE6OF01EOF9H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttatttttaaaggtgtccagtgtgaggtgcagctggtggagtcgtgggggagcttggccagccgtgggggtccctgacgactctccgtgtgcacgtcctgtggacttccaccttctagttatttatgtctatcgctacgtcgggtccgccgtaggccgtaccggaggggaacgggcgtaggtaattagtcgtcgtagtaaggttaagttaaggaacgtaagtacgaacgtaaataaactaagttaattaatttaagtacgtaacctaaaaccgttcgttaggtacggaagggtaccgtaagtaccgtttaaccaaccctagtttacccgtaacccgggtaaacgggtaaacctaaaccgtttaacccgaaaaccggtaaacccttaaccggtacctttaacggtttaaccgtttaaccgtttaaccggtaaaacggggttccgggaactaaccgggttacccgtaaggtaacgggtcgtacgggttacggaacgggtaaccggacggttccgttaagttacgttaaacgtttacgggtaggggtaaggggtaaacgggtagggtaaaccggggtaagggttaaacgggtttaacccggggtaaagggttttacgggggttacggggttaccggggggtaccgggtaaaccgggggg

SEQ ID NO: 267605 - DNA, 782 bp, Homo sapiens
  misc_feature: GYAE6OF01BTV7W.28.57.F02.1.454.CMB.1.raw
  modified_base (682)..(682): a, c, t, g, unknown or other
  misc_feature (682)..(682): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttagttttaaggtgtccagtgtgaggtgcagctggtggtagtcgtgggggagtcttcgggtccaggtccgttgggggtccctggacgctccgtctgtcgcagcctcgtggtacttcctaccgttctagttatttagtgtacttagtgccgtacggtcgggtacccgtccgagggtcccgtaccggaacggggtaacgggtacgtaggtaacgttagtcggttacctaccggttaaggttaacgtttaaaggtaaagttaacgtacggtaacgtaaaacgttaaactaattaaagtttaacttagtacgtaactaaacgttcgttaggtaccgggtaacggactacgtaactccaccgtacgttactaccggtaaggaaccttaacgtaaccgaaacgtaaccgcggttactagttaccgtacttaccgtaaggtccgaacgtacgtaccgtagacggtagtacggttacgacggtaccgacggttacgttacgttaaacgtacggttttaaccgggngggttacgggacgggtaacggttaacggggacggttaaaacggttacgggggtaacggttaagggggtttcgggtaaccgggggaccggttaacccgggg

SEQ ID NO: 267606 - DNA, 771 bp, Homo sapiens
  misc_feature: GYAE6OF01EJY3Y.28.57.F02.1.454.CMB.1.raw
  modified_base (467)..(467): a, c, t, g, unknown or other
  misc_feature (467)..(467): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttatttttaaaggtgtccagtgtgaggtgcagctggtggagtcgtgggggaggcgttggtccagcccggtggggggtcccctgagtacctcctcctgtcgcagccctcgtggtacttccaccctttctagttatttatgtctatcgcctacggtcgggtcccgccgacgggtccgtaccggaagggggaacgggacgtaggtaattagttgtcgtacgtaggttaagttaagtaaagttaactaggaacgtaaaataaactaattaattaattactagtaactaaactcgtagtaggaacggntaagtactaccacctactccgtaccgaacggtaactaacgttaacaaacgtaaccgtaccgtacttacgttaacttaccgttaacgtaaggttaccgggacgtacgtacccggtaggtaacggtacggtacggtaacgggacgggtaaccggtaccgggtacgtttaaggtttaaacgtttaacggtttacggttagggggtacggggaagggtaacggggtaacgggtaagggttaaacgggtttacggggtaaacggggtttaggggttacgggggtacccgggggtagggtaacccggggg

SEQ ID NO: 267607 - DNA, 821 bp, Homo sapiens
  misc_feature: GYAE6OF01D0YYH.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacgggtaggtttgggctggagtcgttgggtttttccttggttgtcttaagtttttaaaggtcgtccgtagtgtgaggtgcgagcgtggtggagtcggtgggggaggtcgttcggtccgaggtccgggttcgggggtccccttggacgtaccgttccttccgtggtcgccgtacgccttcgtaggtacctttaccttacctttacggtaatttattttacgtgtaccttagtcgcgtacggtcgggtcccgacgacggtccgtacggaggggaacggtagtaggtactagtcgtacgtacggtaaggttaataagtaagtaacgacggaaacgttaaacaaacttataaagtttagttaatacgtaacctaagtaggttagaacggtacgactaacggttactaccgtactaacgttcccgaaagtaaccgggtaaactaaccgtaacgtaaaccgtaagtaacccgtgtttaacggtaaccttacggttaacgtaacggtccggtacggtaccgtaacggtaggaaaccgggttacgtacgggtaacggggaaccgtacgggtaccggtttaacggtttagtaaccggttttaaagtccggggtttaaggaacgggttaagggaaccggtaggtaaccggtttaaggttaacgggtacggttaggggtaccgggtacgggaaccggtaccggg

SEQ ID NO: 267608 - DNA, 707 bp, Homo sapiens
  misc_feature: GYAE6OF01DNH35.28.57.F02.1.454.CMB.1.raw
  modified_base (208)..(208): a, c, t, g, unknown or other
  misc_feature (208)..(208): n is a, c, g, or t
  modified_base (690)..(690): a, c, t, g, unknown or other
  misc_feature (690)..(690): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcctgggttttccttgttgcttatttttaaaggtgtccagtgtgaggtgcagctggtggagtcgngggggaggcttggtccaggcccgtggggggtccctgagactctccgtgtcgcacgcctctggacttccaccttcagttatttatgtactatcgactacgtcggggtcccgccgacggccgtccgaagggggacgggaacctaggggaactagttacgttcgtaccggtaggttaacttaaggtaagttaacgtggtaacggtaaataaacctaatttaattaagtttaagtacggaacctaaacgttacgtagggtaaggtaaacggggtcaagtacgtttaacccacctaacttccgtacccgaagggtacctaacgttaaccaacgaaccacgtacttagtacttactacgaagtcggacacgtcctaggactaggctaggacggacgtacggcttaggtattaacggttacgtagggtagggaaggtacggacgggtacggtaaaggtttcgggaaacggggttttgggttaacggggngggttaccggaacgggg

SEQ ID NO: 267609 - DNA, 780 bp, Homo sapiens
  misc_feature: GYAE6OF01A6CCW.28.57.F02.1.454.CMB.1.raw
  modified_base (215)..(215): a, c, t, g, unknown or other
  misc_feature (215)..(215): n is a, c, g, or t
  modified_base (760)..(760): a, c, t, g, unknown or other
  misc_feature (760)..(760): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacgggtagtttgggctggagtcttggggtttttcccttggttgtcttaagttttttaaagggtgtaccaggttgtggaggttcgacngtcgtgggtggagtcggtgggggagtcgttgggtcctacggtcccggttcggggggtcccctggaagtccttccgttcccgtggtcgctacggtcctcggtcggttacttcccacccgtttagtacggttttaattttacgcgtacttattcggaccgttcgggtccggtacccgaccgtacggtccgtaaccggaagggggtaccgtataggaattcgtcgtctacgtaggttataagtaagtagcgtaacaaaagtataattaactattaagcgtaaccctaagttcgtaggaacgggtacggtataccgtacttccgaacgtacttaccgacggaacgtaaccttaaaccgtacgaaacgtaccctacgtacgttagtaacttacgtaaggtagttaccgggaccgttagaccgtaggaacgtggtaacccaaggggtaacgccggttaactggtacctttaaagttagtccgggttagggtagggaaaggtttcggaggttaccgttagggttaaaccgggtacggttggggtacccgggngggttacccggtaacggggg

SEQ ID NO: 267610 - DNA, 853 bp, Homo sapiens
  misc_feature: GYAE6OF01D6NH8.28.57.F02.1.454.CMB.1.raw
  modified_base (301)..(301): a, c, t, g, unknown or other
  misc_feature (301)..(301): n is a, c, g, or t
  modified_base (308)..(308): a, c, t, g, unknown or other
  misc_feature (308)..(308): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacgggagtttgggctggagcgtgggttttccttgttgtcttagttttaaaggtgtccagtggtgaggtgcaggtctgggtggagtcggtgggggaggtcttggccagccggtggggggtccctgagacctctccgtggtgcagtcctgtggtacttcctaaccttctaagttntttagtntacgtatacggctaccggtcgggtcccgcgtaccgggtaccgtaccgggaagggggtaacgggtaaccgtagggtaaattacgttacggttaccgtaaggtaaggttaaagttaagtaaaggttaactggaaaccgtaaataactaattaattaattagtacgtaacctaaacgtccgttaggaaggtacgaacgtagtacttacacctacgtaccgtaccggtaaggtaactaaccgttaaccgaaacgtaaccgtaaccgttaccgtacgtttaacgttaccgttaacgtaaacggtacgggtacaaccggttaccggtaaggtaaccggtacggtaaccggttaggggtaacccgtaaccgggtacgggttaacgttaaacggttttacggttaaccggtttacgggttaacggggttagggggaaccgggttaaaggggaacggggttaacggttaaacggggtttaaaccggggttaaaggggttttacccggggggggttaaaggggttccccggggggttaaggggtaacccgggggg

SEQ ID NO: 267611 - DNA, 704 bp, Homo sapiens
  misc_feature: GYAE6OF01DR4SJ.28.57.F02.1.454.CMB.1.raw
  modified_base (528)..(528): a, c, t, g, unknown or other
  misc_feature (528)..(528): n is a, c, g, or t
  modified_base (558)..(558): a, c, t, g, unknown or other
  misc_feature (558)..(558): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggtgtccagtgtggaggtgcagcgtgggtggtacggtcggtggggggaggtcgttacgggtccgacggtcccggtcggggggttcccctaggacgtcctcttccgtggtcgcacgtcctcgtggtacttcctaccttctagttattaagtcgtctagtcgctacggtcgggcccgcgaggcctacggaggggaacggtacgtggtaaatgtcgtctacgtaggtaataagaagtaatgaacgtaaataatattaatattaagtcgaactaacttcgtaggtaggaaagggctagtacttaccactagtacctacggaaggtaactaacgttaccaagtaaccctcgtnttaacgtacttaccgtaactaaggtccggnacgtccgtaaggagtaccgtagtagggaacgtaccgacggttgttaacgtacgttagttacggggtcggtaagggacggtaaggggtactaacgggtagttaacgggggtaggttagggggtcggtaccgggggtcggtaaccggg

SEQ ID NO: 267612 - DNA, 691 bp, Homo sapiens
  misc_feature: GYAE6OF01BVA25.28.57.F02.1.454.CMB.1.raw
  modified_base (172)..(172): a, c, t, g, unknown or other
  misc_feature (172)..(172): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttccttgttgctattttaaaggngtcagtgtgaggtgcagctggtggagtcgtgggggagcgttggtccagccgtgggggtccctgagactctcctgtgcagcctctggactccaccttcagttatttatgtactattgcacgtcgggtcccgaccgacggtctacccggtaggggaacgggtaacgtagggtaatacgttgttacgtacgtaggtaagttaaggtaaagttaagtacgacgaaaataaactaattaacttaattagtacgaactaaaacgtcgttaggtaaggaagggtaccaagtacttacccgaacctacgttacgttacccgaagggaacctaaacgttaacccaaacgaaccgaacgtacttacgtacgttacctttaacgaaagttgggacaacgtaccgtaggaagacggacgtacgaaggacccgtaggtacgtagttagtacgttagtcggtaggggaggagggagtaacgggtaagttacgggtaacgggttaggggttaggcgggggtaccgaaccggggg

SEQ ID NO: 267613 - DNA, 749 bp, Homo sapiens
  misc_feature: GYAE6OF01D5OOZ.28.57.F02.1.454.CMB.1.raw
  modified_base (183)..(183): a, c, t, g, unknown or other
  misc_feature (183)..(183): n is a, c, g, or t
  modified_base (694)..(694): a, c, t, g, unknown or other
  misc_feature (694)..(694): n is a, c, g, or t
tcagagtacgctatcacgaccggtgctcgatttagctcgatatagttgggtctgggagaggagcccccgccctgggtttcccaggtgttctcgatttggtgatcagcactgcacacagaagagtcatgacggagtttgggctgagtcgttgggttttccttggttgacttaatttttaaaggngtaccagttgtgaggtgcagtcgtggtggacgtcggtagggggcgtcgttacggtccgacggtccgggttcggggggtcccctaggaacgtccttccgttccgtgtcgactacgtcccgttcgttacggtaactttccgtaacctttcgtaagtttactttagtcggtacttatcggactaccggtcggtcccgacgacggtccgtacggtagggaacgtacgtaggatacgtacgtactacgtaagttaacgtaagtaagtagtacgaacgtaaactacgtattaacttagttacgactaaccgtaaacgttcgtaacggtaagaacggtactaacgtaccttacgaacctacgttaccgaacggtaacggtaaacctaacgttaaaccgaacgtaccgtaacggttacttacggttattaaccgtacgtaagtcggacgtaaccgtacgtaacggtacgtaccggaacgttcggaaccgtcgtacggtattacgtagttacgttagggnggttaggagacggtagacggttagtcggttaacgggtggtcgggcgcggtaacgg

SEQ ID NO: 267614 - DNA, 752 bp, Homo sapiens
  misc_feature: GYAE6OF01EZF5U.28.57.F02.1.454.CMB.1.raw
  modified_base (174)..(174): a, c, t, g, unknown or other
  misc_feature (174)..(174): n is a, c, g, or t
  modified_base (261)..(261): a, c, t, g, unknown or other
  misc_feature (261)..(261): n is a, c, g, or t
  modified_base (321)..(321): a, c, t, g, unknown or other
  misc_feature (321)..(321): n is a, c, g, or t
tcagagtacgctatcacgaccggtgctcgatttagctcgatatagttggggtctgggagaggagccccgccctggttcccaggtgttctcatttggtgatcagcactgcacacagaagagtcatgacggagtttgggctgagctgggttttccttgttgtctattttaaaggtntcctaagtgtgaggtgcagctggtggagtcgtgggggagtcgttggtccaggccgtggggggtccctggacgtacctctcctgtgcngcctcgtggattccaccttcagttattatgctatgccactcgggttaccccgccgacgcnggtacggtacggtaggtacgtagtagtacgtcgtacgtagtagtaagtaagtaacgtacgtaacgtacgtaacgtaactaatatatactacgtacgtacgtacgtacggtacgtacggtacgtacgtacgtactacgtacctacgtaaccgtaacgtaacgaaacgttaccctaacgtaaccgtaaccgtaccttacgttaacgttaacgttaccgtaaacgtaacgggtacccgtaacggtaacccgtaacggtaaccggtaacgggaaccgtaaccggtaaccgggtaaccgtaaccgggtaaccgtacggttaacggttaacggttaaccgggttacgggttaacgggggtaacgggttaacgggttaaacgggttacggggtaaacgggtttaacgggggttaacgggttaacgggggttaccgggg

SEQ ID NO: 267615 - DNA, 780 bp, Homo sapiens
  misc_feature: GYAE6OF01DQ7EJ.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatgacggtaggtttgggctggagtcgttgggtttttccttgttgtcttaagttttttaaaggtgtccgtaggtgtggaggtgcgagcgtggtcggagtcggtgggggaggtcgttcgggtccacggtccggttcgggggggtccctaggacgtacctccgttccgtgtcgcacgtcctcgtaggtacttcctaccgttctaagttattacgtgtactagtcgacgtacggtccgggtcccgcgacggtaccgtacgggaaggggtacggtacgtaggtaatcgttcgtacgttacggtaaggttaacgtaaggtaaagtacgtacgaacgtaaactaactaagttacttaagtttactacgtaacgtaaacgtcgttaggtaacggtacggtaactaacggttactaccctactacgttaccgtaacgggtaacggtacctaaacgttacccggaaacaaccgtacggttcctaagtttacctactaacgtaaggtgacgtacgcgtagagtacggttagacgaacggccgttaggtaccttaaggtaccgttacgttacggtagggtagggtaaaggtaggggaacgttagggttaaaccggttaggggttaacggtttgggggtaacgggtccgggggtacgtaaccggggg

SEQ ID NO: 267616 - DNA, 797 bp, Homo sapiens
  misc_feature: GYAE6OF01DMPNW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggtttttccttgttgtcttaatttttaaaggtgtccagtgtgaggtgcagtcgtggtggagtcggtgggggagtcgttggtcccgaggcccggttcggggggtcccctaggacgtaccttccgtccgtgtcgccgtacgtcccttcgtggtacttcctaaccctttcgtaagttttaatttatcgtactagtcgaccgtaccggttccggggtcccgaccgtacggtccgtaccgggtaagggggaacggtacgtaggtaaattgttacgtcttaacggtaagttaagttaagaaagtttaagtcggtaaacgtaaaatttaacgaattttaaacttaagtttaacgtacgtaaacccgtaaacgtttacggttaggtaacggaaagggtacctaacgttaacgttaccctaacccgtaacttaccgtaccggaacggtaaactaaacgttaaccgaacgtaacctacgtacgtagttacttacgttaacaacggtcggtacacgtaccgtaggagtacgagtaacggacggaccgacgtacgttaattacgttagttacggtacgggtagggacggtaagggacggtagggttaaacggttagggttaacgggttagggttacgggtcggggaccggtaacggggg

SEQ ID NO: 267617 - DNA, 743 bp, Homo sapiens
  misc_feature: GYAE6OF01CPI40.28.57.F02.1.454.CMB.1.raw
  modified_base (613)..(613): a, c, t, g, unknown or other
  misc_feature (613)..(613): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttaatttttaaaggtgtccagtgtgaggtgcagcgtggtggagtcggtgggggagtcgttcggtcccgaggtcccggttcgggggggtccccttaggacggtaccttccgtccgttgtcgccgacgtcccgttcgtaggtactttccgtacctttcgtaagtttactttagtcgacttagtacgtccgtacggttccgggcccgccgtaaggtccctaccggaaggggtaaacgggactaagggaaacttacgtcgttaccgttaacggtaaggttaaagtttaaacggaaaaggtttaacgtacggtaacgtaaaaacttaaacgtaaattactttaaacttagtaacgtaacctaaacgttcgtaggttaagggaacggtctaagggtacttacccgaacctagtacccgtacggaacgtaaactaacgtaaccaagaccgacgtnttaacgtcttaacttacgaagtcgatccgacgtagacgtgacgttacgggactcggacgttagttatagtaggtggaggaagtggacgtaggttgtaagggtaacggttgggtgggcggtcggtaacggg

SEQ ID NO: 267618 - DNA, 1038 bp, Homo sapiens
  misc_feature: GYAE6OF01BQS96.28.57.F02.1.454.CMB.1.raw
tcagagtacgctatcacgaccggtgctcgatttagctcgatatagttgggtctgggagaggagcccccgccctgggtttcccaggtgttctcatttggtgatcagcacctgcacacagaagagtcatggacgggtaggttttgggctggagtcgttgggtttttccttggttgtctttaagtttttaaaggtgtccgaggttgtggaggtgcaggtcgttgggtgggtaggttcgggtggggggtacggtcgttcgggtccgacgggtccggttcggggggtccctgacgtaccttctccgtgtcgcgtacgtccgtcgtacgtacttaccgtaccttacgttaagtttactttagttcgtattagtacgaccttaccgggtccggggttcccgaccccggtacgggtacccggtaacccggggaaacgggggtaaaccggggacggttaaggttaaacgtacggtttacgttaccgttaacgggttaacggttaaaagtttaaaaggtaaacggtaaggttacggtaacgttaaaaacgtaaaccgttaagtttaactttaaagttaacggtaacttaaaccggtaaaacttacggtttacgggtaaacgggtaaacggggtaccgttaacgggttaaccttaacccgtaacccgttaaccggttacccggttaaacccgggtaaaacgggtaaaacccttaaacccggttaaacccggtaaaaccgggtaacccgtaacgtttaaccgtttaacggttaaccttttaacccggtttaaacgaacggggttaccggaaccgtaacgggtaccggtaaggggaaccggtacggtaaccggtaacggggacggtaacccgggtaacggttaccggtttaaacgtttaacggtttaaacggttacgggtaaggggttaaggggaaacggggtagggttaaacccggggtaaaggggtttaaacgggttaacccggggtttaaagggggtttaaggggtttaccggggggtaaaccggggaccggggttaaacccgggggg

SEQ ID NO: 267619 - DNA, 795 bp, Homo sapiens
  misc_feature: GYAE6OF01BIK2Y.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtctgggttttccttgttgtcttaatttttaaaggtgtccagtgtgaggtgcagctggtggagtcgtgggggagcgttcggtccaggccgtgggggtcccctggacgacctcgtcctggtcgcacgtcctcgtgtacttccctaacctttcgtagttatttagtcgtactatcgacgtaccggtccggttcccgccgtacggcctaccggaggggtaacggtacgtaggaacttagtcgtactacgtaggttattaagtaagtacgtagtaacgtaaataaactattaatattaatacgtaaacctaaacttcggttaggtaacgggaacggtactaacggtaacttacccgtaaacctacgttaccccgtaaccggtaaacggtaaacctaaacgttaacccgaaaacgtaccgtaccgttacgttacgtttaacttacgttaaacgtaacggtacgggactaaccggtcgttaagggacgtaaccggacgttaccggggaaggtaaacccgtccggtaaggtttacgttaaacgttaccgttttagggacgggtaaacggggaggttaacccggaagggttaaccgggttaaagggttacccggtttaggggtacggggtttggggacccgggggtggtaaacccggggg

SEQ ID NO: 267620 - DNA, 902 bp, Homo sapiens
  misc_feature: GYAE6OF01C0IBX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgcttaagtttttaaaggtgtccagtgtgaggtgcagcgtggtggagtcggtgggggagtcgttcggtccaggtcccggtcgggggtacccctggaacgtccttccgtcctggtcgcgtacgtccttacgtggtacttacctacctttacgtaagttttaacttttaagtcgtaccttagtcggtaccgtaccggttccggggtaccccgacccggtacggtacccgttacccgggaaagggggtaacgggtaaccgttagggtaaaattcgttcggttaccgttacggttaaaggttaacgtttaaaggaaacgttaagtacgtaaacgttaaaacttaaacgtaatttaaagttagtttaacgtacgtaaacctaaacgtttacgttaggtacggtaagggacttaaggtaccttacccgaacctacgttacccgaccgggtaaaggttaaacctaaacgttaacccgaaaagtacccgtaacggttactttaaccgtactttaacccgttaagaaacgggttccggacctaaacggttccggtaaaggaccgggtacgtacggtaacgggtaaccggtaccgtaccggttaaaccgtttaagttaacgtttaagggtttacgggtacggggttaggggaaacgggtaagggtacccggggttaagggttaaacggttaacggggttaaacgggtttagggggtacggggtaccccggggccggttaaacccggggg

SEQ ID NO: 267621 - DNA, 710 bp, Homo sapiens
  misc_feature: GYAE6OF01DDWFL.28.57.F02.1.454.CMB.1.raw
  modified_base (178)..(178): a, c, t, g, unknown or other
  misc_feature (178)..(178): n is a, c, g, or t
  modified_base (193)..(193): a, c, t, g, unknown or other
  misc_feature (193)..(193): n is a, c, g, or t
  modified_base (319)..(319): a, c, t, g, unknown or other
  misc_feature (319)..(319): n is a, c, g, or t
  modified_base (355)..(355): a, c, t, g, unknown or other
  misc_feature (355)..(355): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggngtccagtgtgaggtncagctggtggagtcgtgggggagcttggtccagccgtgggggtcctggagctctccgtgtcgcacggccttcgtggtacttcctacctttcagtttatttatgtctatcgtcacggtcgggtaccnccgagcgtaccggaaggggaagggacgtaggaactntacgtctacggtaggtaataaggaaacgttagacggtactaaaagtaactagttaattaagtttacacggtaactaaacctgtaggtaaggaacggtactaagtacttaccaactactacctacgtaacggaaactaacgttaccaaagtaccaacgtntacgtaacttcgtaacaaggttcgggaactacgtaccgaggtaacggtcgtactcgggaaccgtagaaccgggtacttaggtaaacctttaggttaaggtggggtagggtaaggacgggtaaggtaaccgggttaagggttaacgggttaaacgggttggggttacgggtaaacgggggtccccggtaaacggggg

SEQ ID NO: 267622 - DNA, 832 bp, Homo sapiens
  misc_feature: GYAE6OF01EU67N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcggtgggggaggtcgttggtccgaggtccgtcggggggtccctgacgtactctcctgtgcacgtcctcgtgtacttcctaccttacgtagttatttagtgtcttatgctacgtcgggtcccgccgacggtccgtaccggaaggggtaacggacgtaggtaattagttcgtacgttacgtaaggtttaattaaggtaaagttaagtacggtaaacgtaaaattaaacctaatttaagtttaactttaagttaaccgtaaccttaaaacgtttccggtaggttaacggggaaacgggtacgttaaacggtaccttaacccgtaaacccgtaacgtttaccccgtaacccggtaaacgggtaaacctaaccgttaaccgaaaaccgtaaccgtaccgttacgttaaccgtttacgttaccgtttaacgtaaacggtcgggtacaaccggtaccgtaggacgtacgacgttaagggacgtacccgtacggttacgttaacgttaacttaacggttacggttaggggtaacggggtaagggaaccgggtaaggggttaacggttaaagggttacggggtaaacggggtttagggggtttaccggggtccggggtaaccgggtaaccggggg

SEQ ID NO: 267623 - DNA, 825 bp, Homo sapiens
  misc_feature: GYAE6OF01B99LG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggtccagccggtggggggtccctgagtacctctcctgtgcacgcctcgtggtattccaccttcgtagttactttatgtcttatcgcacgttcgggtcccgaccgagggtcctaccgaagggggaacgggacgtaggtaaagtacgtgtacgtacgtaaggttaacgttaaggaaaggtaacgtaggaaccgtaaaataaactattaacgtttatttaactagaacttaaacgtacgttaggtaaggtaaaggggacaaggtacttacccaaccctaacgttacccgtacccggaaagggtaaacccttaaacgttaacccggtaaaaacaacccgttaaccgtcgtttaacggtttaacccttaaccgtttaaacgtaaacggttcgggaactaacccggtaccgtaaggtaaggtaaccgcgttaaacggaccgggtaacgtacccgggtagtttaccggtttaaagttaaccggtttaacggttcgggggtaaaggggaacgggttaagggggaaccgggtaagggtttaaacgggttaaacggggttaacggggtttaagggggtttcccggggtagggggggaaccccgggtaaaccgggggg

SEQ ID NO: 267624 - DNA, 758 bp, Homo sapiens
  misc_feature: GYAE6OF01DBLTK.28.57.F02.1.454.CMB.1.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
  modified_base (543)..(543): a, c, t, g, unknown or other
  misc_feature (543)..(543): n is a, c, g, or t
  modified_base (597)..(597): a, c, t, g, unknown or other
  misc_feature (597)..(597): n is a, c, g, or t
  modified_base (621)..(621): a, c, t, g, unknown or other
  misc_feature (621)..(621): n is a, c, g, or t
  modified_base (686)..(686): a, c, t, g, unknown or other
  misc_feature (686)..(686): n is a, c, g, or t
tcagagtacgctatcacgaccggtgctcgatttagctcgatatagttgggtcgtgggagaggagcccccgccctgggtttcccaggtgttctcatttggtgatccagcacgtgcacacagaagagtcatgacggtagttgggctgagtcgttgggttttccttgttcgtacttaagtttttaaaggtcgtcctaggttgtggaggtgcgagtcgtgggtaggacgttcggtgggggtgtcgttggtcccacggtccgggttcggggggtacccctggacgtccttccgtccgtggtcgcnccgtccttcgtaggtaccttcctacccgtttntagtttatttacgtcgtaaccgttagtcggacctcggttccgggtccccgccggtacggccgtaaccgggaacggggtaacggtacgtagggtaattgttcggtacgtacggtaagttaaggttaagaaagtacgtacggtaacgtaaaactaatacttaagttaagttacacgtaactaaaccgttgtaggacggaaggtcctaaacgtnttacccgacttaccgtcgtacgaacgtaacctaacgttacgaacgtaactcgtntcgttactacgtagtacgcgtacncgctaggaccgtagcgtaggacgtagccgtagttagtacgtagttaccggtgggaaggtaccggnggaacgggttacggttaaggttaaacggggtacgggtttagggaccggggttccgggcgggttaacccgggg

SEQ ID NO: 267625 - DNA, 835 bp, Homo sapiens
  misc_feature: GYAE6OF01AO6T9.28.57.F02.1.454.CMB.1.raw
  modified_base (169)..(169): a, c, t, g, unknown or other
  misc_feature (169)..(169): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (200)..(200): a, c, t, g, unknown or other
  misc_feature (200)..(200): n is a, c, g, or t
  modified_base (207)..(207): a, c, t, g, unknown or other
  misc_feature (207)..(207): n is a, c, g, or t
  modified_base (231)..(231): a, c, t, g, unknown or other
  misc_feature (231)..(231): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctatttaaggntccagtgtgacggtncagctggnggagtcgngggggancgttggccagccgtgggggtcccngacgactctccgtagtcgcacgtccgtcgtggtacttccgtaccgtttacgaacgtttaactttacgtcggttaccttacgttacggaccgttaaccgggttaccggggtaccccgtaccggtaacgggtacccgttaaccggtaaacggggaaccgggtaccggtaagggtaaccgttaacggttcgtaccggtaaccgttaagggtttaactaacgggtaaacgtttaacgtacggtaactaaaccgttaacggaactttaaggttaacctttaaggtaccgtaacccggtaaaccgttaggttacggtaacggttaacgggactaacggtaaccttacggacctacgtacccgtacgtacggtaaccttaacgtaaccgtaaacgaccgtacggtacgttacggtaagttaccgttaacggaaccgttagggtaaccgtacggtaaccggtagtaaccgggtacgttaccggaacgtccgggtaacaaccgggtttacgtagtacgttaaccgttaggtcgggtaaggcggaaacccggttggacgggtttaacgtaccggggttaaggttaggggtacggtcccgggtaggtaacccggg

SEQ ID NO: 267626 - DNA, 779 bp, Homo sapiens
  misc_feature: GYAE6OF01C7W8B.28.57.F02.1.454.CMB.1.raw
tcagagtacgctatcacgaccggtgctcgatttagctcgatatagttgggtctgggagaggacgcccccgccctgggtttccccaggtgttctctatttggtgatcagcactgcacacagaagatcatggaggtagttgggctgagtcgttgggttttcttgttgtacttaagttttaaggtcgtccgagttggtaggaggtcgcgaggtcggtgggtggtacggtgggtggggggagtcgttcggtaccgacggtccggggtcgggggtccctagacgtccttcctcgtggtcgacgcgtccgtcgttgtacttacctaccttacgggggggtatttatttagtcgttcgtagtcgtacgtcggtccggtcccgtaccggaccggtaccggacgggaacgggtaacggtaggtaggtaagtacgtcgtacgtacgtagtaagtaagtaagtagtaagaacgtaaactaataagttaattaagttaactaacgtaacgtacgttaggtacggtaacggtaacggtaacgtacgtaactaacctaccgtaaccgtacgtaaccggaacgtaaccgtaacctaaacgtaaccgaacgtacgtacgtacgtaactaacgtaacgtagacgtacgacgtacgacgacgtacgtacggtacgtacggtacgacgttacgttagtacgttaggttacggtagggtaggacgggtaagggtaacgggtaagggttaacgggttagggttacgggtaggggttcggggaccgggtacgggtaccggg

SEQ ID NO: 267627 - DNA, 859 bp, Homo sapiens
  misc_feature: GYAE6OF01D6NA7.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatggacggtagtttgggctgagtcgttggggttttcctttcgtttgtacttaacgtttttaaaaggttagtccgtagttaggtgtaggtagtcgagtcgttggtgggtaggttcgggtgggggtagggtccggttcggtacccgacggtaccgggttcggggggttacccgttcggtaggtaccttccgttccgttagtggccgacgtccccgtgttacggtacttacctaccgtttactaattagtttactgtacttagttcgtacgtaccggttccgggtcccggccggtaaccggtccggtaccggaacgggggtaaacggtacggtacggtaaggttacttgttacgttacggtaaggttaaacgttaagtaaagtaaagtagaaccgttaaaagtaaactaagtttacttaaagttaatacccaaacggttaccttaggttacggtaggtaaacgaacgttactaacgttaacccacccgttagttaccgacccggttaaacgaaacgttaactaaaccggaacgtaacgtaacgttcgttaagtacgtttaacgtaaccgtaaggtccggtaccacggtactacggaaggttccgacggtacgggaacgtaccgtacgttacgtaacgtttagttacgtacgggtggtaacgggagggtaaccggagggttaaccgtaaggggttacggttaacgggttgggttacggggtaccgggccggtacggg

SEQ ID NO: 267628 - DNA, 996 bp, Homo sapiens
  misc_feature: GYAE6OF01CL8TO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttaagttttttaaagggtcgttccaggttggttggagggttgcgagcgttgggtgggaggttcgtggggggagtcgttgggtccaggtccggttcggggggtccctggagtcctcgtcctgtgcaggtcctgtggtacttcctaccgttcgaagtttattttaagtgtccttagtcgtacgtcggttcgggtcccgaccgaacgggtcccgttacccgggtaaagggggaaagggtaccgttaggggaaaactttacgtggtttccgtaaggtaagggtttaaagttaaggtaaagttaacgtcggaacgttaaaactaaaacgtattaaaagtttaacgtttaacgtacgtaaaccgttaaaaccgttccggttaaaggtaacggggtaaaacggggtacgtaacgttaaaccgtttaccccgaaacccgttaacgtttaccccgtaaacccgggtaaaccggggttaaacctaaacccgttaaaccgtaaaacccggttaacgaacccggtttaccggttaacgttttaacccgtttaaccggttaaacgtaaaacgggttaccgggttaacgaacccggttaaccgttacgggaacggttaacgggtaccggttacggtaaacccgggtacgggtaaccggttaaccggtttaacggttaacggttttaaacgtttaaccggggtttacgggggtaagggttaaggggaaaacggggttacgggtaaaccggggttaaaggtttaaaccgggggttaaacgggggttttaacgggggtttaccggggggtttagggggggtaaaccccggggttaaacccgggggggg

SEQ ID NO: 267629 - DNA, 727 bp, Homo sapiens
  misc_feature: GYAE6OF01A7MRS.28.57.F02.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (308)..(308): a, c, t, g, unknown or other
  misc_feature (308)..(308): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgnagctggtggagtcngggggaggcttgggtccagccgtggggggtccctggagactctcctgtgcagcctcgtggacttcaccttcagttactttatgctatcgctacgtcgggtccncgaggcctaccggaaggggaaggacgtaggaattagtacgtctcgtaaggtattaaggaactagtacgaacgaaacgtaaacaagttattaattaagtagacctaaacttcgaggttagggaacgggtacgaagtaacttccaactacgtcctaaccggtaacgggaacctaacttaacccgaaacgaacccgtaacggtccttagtacttaccgttaacgtaaacggttcgggaaccgtacgaccgtggtaaaggtcgaggttacggacggggaacctaccggtcgttacgttaagtttaacgttacggtacggggtttagggaagggtagggaacggggtacggttaaaggttacggggtaaaacggggttttagggggttaccggggttccggggggaccggtaaacccggggggg

SEQ ID NO: 267630 - DNA, 670 bp, Homo sapiens
  misc_feature: GYAE6OF01CBEHY.28.57.F02.1.454.CMB.1.raw
  modified_base (199)..(199): a, c, t, g, unknown or other
  misc_feature (199)..(199): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaagtttttaaaggtgtccagtgtgaggtgcagntgggtggagtggtgggggagcttggtccagccggtgggggtccctgagtactctctgtnctcgcctctggtattccaccttctagttatttatnctatcgctacggtcggtccgcgacgccgtacggagggaacggtacgtaggaatagtcgtcgtacgtaggttataagtaagtagtagacgtaaataactattaatattatacgtactaacgtctagagggtacgtacgacgtacttacaactctacgtacgaaggtaactaacgtaacaacgtaaccgactacgttatacgttacctaacgtaagtggacacggtacgtagtagaccgtagtaaggacggtacgacggtcgtaagtacgttagtttacggtcgggtagggtaacggtacggggtaggtaaacggttacgggttaaacgggtaacggggttaggggttacgggggtaccgggggtcgggtaaccggggg

SEQ ID NO: 267631 - DNA, 783 bp, Homo sapiens
  misc_feature: GYAE6OF01DTA23.28.57.F02.1.454.CMB.1.raw
  modified_base (673)..(673): a, c, t, g, unknown or other
  misc_feature (673)..(673): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
  modified_base (694)..(694): a, c, t, g, unknown or other
  misc_feature (694)..(694): n is a, c, g, or t
  modified_base (772)..(772): a, c, t, g, unknown or other
  misc_feature (772)..(772): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcgttgggtttttccttgttgtacttaagtttttaaaggtcgtccagtggtgcggtgtcagcgtgggtggagtcgggtgggggcggtcttcgggtaccgacggtccgggttccggggggggttacccctaggtacgtaccttccgttcccgttcggtccgcgtaccggtccccgttacggttaggttaacccttttccctaacccgttttccgttaaggttttaactttttagtcggtaccttacggttcggtaccgtacccgggttcccggggttacccgacccgggtacgggtacccgtaccggggaaaggggggtaacggtaccgttaggtaattcggttcgtacgtaagtacgggtttaataggaaaacgttagtacgtaaaccggtaaataataacgttaagtaatttagtacgtaaccctagtagttacggaggtacgacgtagttactacgtactcgtacgtacgaacgtaactaacggtacaacgaccgtgtgtactagttcgtaagtacgtgactcgngacgagtncggganaaccggngtacggtactattacgtcgtaggtacgggtgaacggcggtaagtacggttaacggtacgggtaggtggggtgcggggngtacccggggg

SEQ ID NO: 267632 - DNA, 898 bp, Homo sapiens
  misc_feature: GYAE6OF01AMD2A.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcagtggacggtaggtttggggctgagtcgttggggtttttccttgttgtactttaagtttttaaaggtgtccaggttgtggagggtgcaggtcgtgggtggaggttcgggtgggggggtacggtcgtttcgggtacccgtacggtcccggggttcggggggggttcccttaggaacgtaccgttccgttccgttggtcggccacggtccctgttacgggtactttaccctaccctttacgaaggttttaacttttagttacgtctttaagtcggtaccgtaccggttcggggtccccggacccgaggggtacccgttacccggggaaaggggggtaacgggtacgttaagggtaaattacggttacgggtacttaacggtaaggttttaacggtttaaaggtaaaggtttaaacgtccgggtaaaacgtaaaaactttaaacgtaaagtttaattttaaacgtttacgtacggtaaaccttaaaacggttcgttaagggttaacgggaacggtcgaacgtacttacgtaacctacgtaccgtaaccggacggtaaactaacgtaaccaaacggtaccgtacgtctacgttaagttccttaaacggagtcgggtacgaccggtcgaacggtacgaggtaccggaaggacgggaccgtacggttagtacttaggttacgttacggtggggttaggacggaagggttacggtaaggggttaagggttaacgggttacggggttaggggttccgggacggggttacgggtaaccggggg

SEQ ID NO: 267633 - DNA, 912 bp, Homo sapiens
  misc_feature: GYAE6OF01CS13Q.28.57.F02.1.454.CMB.1.raw
  modified_base (210)..(210): a, c, t, g, unknown or other
  misc_feature (210)..(210): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgcttaatttttaaggtgtccagtgtgagtgcagctggtggagtcggngggggagtcttcggtccagccggtgggggtccctgacgactctctgtgcagcctcgngtacttccaccttacgatttatttacngtacttagtcgactacggtccggtacccgcgaccggtcnccggtaagggggaacggtacgagggttaactagttcgttaccgttaacggtaaggtttaattaaaggtaagttaacgtacggtaaaccgtaaattaaaccgtagtttaaatttaagtttaacgtactaaaccccgttaacgtttaacggttaacgggttaacgggtaaacggtacgttaaccggttaacctttaaccccggaaccctttaacccggttaaccgtaaccccggggtaaacggttaaaccccttaaacggtttaaaaccccgaaaccgaaaccgttacccggttacgtttaaacgttaccttttaacccggtttaaacaacggggtttcccgggaaccgtacggttaacccggttaaccggggaaagtttaacccgggttagggaaccgtaaaccggggtaccgaacggttttacgtaaccgttttaaaacggtttccggttaagggttaaccggggtaaggggaacgggtaaacggggtaaccgggttaaaccgttaggggttttaaaacggggtacgggtttaaggggggtttacccggggtcgggggttacccgtaaacccggggggg

SEQ ID NO: 267634 - DNA, 763 bp, Homo sapiens
  misc_feature: GYAE6OF01B16V3.28.57.F02.1.454.CMB.1.raw
  modified_base (688)..(688): a, c, t, g, unknown or other
  misc_feature (688)..(688): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgaggtgcagcgttgggtggtaggttcggtggggggtagtcgttcgggtcccacggtcccggttcggggggtcccctggaggtaccttcctccgtggtcgcacgtcctcgtggtacttacctacccgtttctaagttattttactcgtacttacgtacggtcttaccggtccggggtccccgaccgtacgggtcccgtaccgggaagggggtaaacggggtacttacgggtaaattgtcgttacgttaggtaaggttaagttaagtaagtaatacgtacgtaaactaaactaattaatttaattactagaactaaacgtcgtaggtacggaacgggtactagtactactacctactaccgtcgaacggtaactaacgtaacgaaacgtacaccgttagtacttacgttaactacgtaacgtccggactaccgtcgaagtcgacggttacgaggaacggaccgtcggtagttagttaaacgttacgtagggttgggaaggggnggtaaacggggtacgaacgggtttaaggtacgggttaacggggtaggggttaggtcccgggggacgggtacgggg

SEQ ID NO: 267635 - DNA, 825 bp, Homo sapiens
  misc_feature: GYAE6OF01C31IA.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatggacggagtttggggctggagtcttggggtttttccttgttgtactttaagttttttaaagggtcgttaccgaggttggtggaggtcgcaggtcgttggggtagggtaggttcgggtggggggaggtcggtttacgggtcccgacggtcccggggttcgggggggtcccctaggacgtcttccgttccgtggtcgaccgacgtcccttacgtggttacctttccttacctttacgttaggtttatttagtcgtattacgtcgtacgtcggtcggggtccccgacggacggtccgtacggaacggggaagggacgttaggaattcgtagtccgtagtaaggttaagttaaaggtaaagtagtaaggtaaacctaaaataacttaagtttaagtttattaaacgttagtaacctaaaacgttggttaaggacggtaaacgggcgttaagtacttaccgaacgtacctaccgtaacggaacgtaaacgtaacttaaccgaaacgtaaccacggtacttacgtacgttaaccttaaggaacggttacggtacggtaccggaagtacggtaggtacgacggtacgacggtaacgaccggtattaggttaactaggttacggtacgggtagggaagtcgggaaagggttacggtaaaggttacggggtaacggtaggggttcggggtacggcgggttacgggg

SEQ ID NO: 267636 - DNA, 843 bp, Homo sapiens
  misc_feature: GYAE6OF01BVAYR.28.57.F02.1.454.CMB.1.raw
  modified_base (682)..(682): a, c, t, g, unknown or other
  misc_feature (682)..(682): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgtcttatttttaaggtgtccagtgtgaggtgcagctggtggagtcggtgggggagtcgttggtccacggtccggttcggggggtccctaggacgtacctctccgtgtcgctacgtcctgttcggtattcccgtacctttgtaagttttatttaacgtcgtaccgtttatcggtacctaccgggttccggggtacccgtcccggaacggtccccgttaccgggaacgggggtaaacgggtaaccggttaggtaaacgttcgtttacggtcgttaacgtaagggtttaaagtttaaaggtaaaaggttaacgtggtaaactaaaaccgtaaattaagtttaatttaattacgtaacgtaacctaaacgttcggtttaaggaacggtaacggtacgtaagttacccgtttaaccaaccgttacttacccgtaaccgggtaacgtaacttaaaacccggtaacgaaaccgtaacctaccggttaattacgttaaccttcgttaaaacggtaagtccgggtaacnccggtaaccgtaggaacggtacgtcgggttaacgaacgggtacccgaacgttcgttaagttacgttaaagttcgggtacggggttaagggacgggtaacggtaggtacggtttaaggtacggtaacgggtttagggacgggttcgggccgggttaaccggg

SEQ ID NO: 267637 - DNA, 764 bp, Homo sapiens
  misc_feature: GYAE6OF01B8UOL.28.57.F02.1.454.CMB.1.raw
  modified_base (218)..(218): a, c, t, g, unknown or other
  misc_feature (218)..(218): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttcctttgttgcttagtttttaaaggtgtccagtgtgaggtgcagctggtggagtcgtggggggnggtcgttcgggtccaggtcccggtcgggggggtcccctggacgtaccgttccttccgtggtcggcctacgcctccgtggtactttacctacctttctaagttaacttttatcggtacttagtcgaccgtaccgttccggggtacccacccgacgggtcccgtacccggaagggggaaacgggtacgtaggtaattagtcgtacgtacggtaaggttaagttaaggtaaagttaagtacggaacgtaaattaaacgtattaaattaatttaatacgtaactaaacttcgtaggtaaggtaagggactacgtacttacaacctacgtacctaaccggtaacgaaccttaaacgtaacccgaaacgaaccgccgtacgttacgttaacttacgttaacgaacggttcgggacacggtccgagacgtaggtacgtacggacgggacctaggtcgttagttacgttacgttaggtaggggtagggaagggacggtaagggtaggtaaggttaagggttacggttaggggtcggtaacggggcggtacgggg

SEQ ID NO: 267638 - DNA, 799 bp, Homo sapiens
  misc_feature: GYAE6OF01CN8T6.28.57.F02.1.454.CMB.1.raw
  modified_base (218)..(218): a, c, t, g, unknown or other
  misc_feature (218)..(218): n is a, c, g, or t
  modified_base (325)..(325): a, c, t, g, unknown or other
  misc_feature (325)..(325): n is a, c, g, or t
  modified_base (336)..(336): a, c, t, g, unknown or other
  misc_feature (336)..(336): n is a, c, g, or t
  modified_base (488)..(488): a, c, t, g, unknown or other
  misc_feature (488)..(488): n is a, c, g, or t
tcagagtacgctatcacgaccggtgctcgatttagctcgatatagttgggtcgtgggagaggacgccccccgcccgttgggtttcccaggtgttctctagttttggtgatcagccacctgaccaacaacgaagaagagtcagtggagggtagttgggctgacgtcgtttcggttttccttgttgtacgtttaagttttaaggctcgaggtgtgaggtncgagtgtgggtgacggtggtaggggcgtcgttacgccgcggtccgggttcggggtccaggtactcttccgtcgtgcgacgtacgtcctgtagtacctacctacgttnagtttactgtntactgtacgtcgtacggtcggtccgacgcggtacgacgggaggtaacggtacgtaggtaattcgtcgtacgtagaagttagtaaagaagtacgtaacgaaagttaaataataattacgtaattacgagtaaaccgtttaaactgggttaaanacggggtaacagtaacgtacgtacaacgtacgtaaccgaacgtaacgaactaacggtaacaaagtaacccgtcgtaacgttgtaaaccttacgtaaggttaacgcggtaaccgtcgaacgtagggaaactgtaaacgggagttaaacccgaggtacgtttacgtaaagttaccgggtaaggttaacgggtaggtaaaggggtaggtaaaccgggtaaacggggtttaaacggttaacgggttaaaccggggttaaaccgggggtttagggggtaacccggggacccggggttaaccgggggtaaacccggg

SEQ ID NO: 267639 - DNA, 848 bp, Homo sapiens
  misc_feature: GYAE6OF01CV3ML.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggtttttccttggttgtcttaagttttttaaaggtcgtccagtggtggaggtgcagcgtggtggagtcgtggggggagtcgttcggtccgaggcccggttcgggggggttcccctaggacgtaccttccgttcccgtggtcgccacggccctcgtggtacttccaccttttcagttattttatcgtattagtcgccgtacggttcggggtcccgaccggacggtccgtaccggaagggggtaaacgggtaaccgtaggtaaacttcgttacggttccgttaacggtaaggtttaaacgtttaacggtaaaggttaacgtacggaaacgttaaaaactaaaccgttaaattaacgtttaaagtttaacgtaaccggtaaaccctaaaccgtttccggttaaggtaacgggaaacgggtaacctacggttaacctttacccgaaacccgtacgtttacccggtaaccgggaaacggtaaacctaaacgttaacccgaacgtaacctacgtacttacgtacttaccgtttaacgaaggttcgacgtacgtaccgtaggaaacgtgtcgtacggaacggtacccgtacgttactacgtttaagttacgtttaacgggaggggtacgggaagggtaacggtagggtaaccgggttaagttacgggtaaacgggtttggggtacggcggggtacggtaccggggg

SEQ ID NO: 267640 - DNA, 870 bp, Homo sapiens
  misc_feature: GYAE6OF01E010P.28.57.F02.1.454.CMB.1.raw
  modified_base (862)..(862): a, c, t, g, unknown or other
  misc_feature (862)..(862): n is a, c, g, or t
  modified_base (864)..(864): a, c, t, g, unknown or other
  misc_feature (864)..(864): n is a, c, g, or t
  modified_base (866)..(866): a, c, t, g, unknown or other
  misc_feature (866)..(866): n is a, c, g, or t
tcagagtacgctatcacgaccggtgctcgatttagctcgatatagttgggtttggggggtccctgagactctcctgtgcagcctctggattcaccttcagtatttatgctatgcacgtgggtccgccaggctccgaggggaagggacgtggaatatgtctcgaggtattagaagttaatgacgaataacatatattatcgacaaacttctgtaggaagggacagtacttccaacctacttccgtaccgaacggggtaaacctaaacttacccgaaaaggtaaccgaaccgtcgtttagttaacttcctttaacgaaaacggttgggacctaacggcctaggaacggagtcgtagggacggaaccgtacgggtcgtttaggtaagttacgttacggtggggtacgggaaggagggtaggtacggtaaggttagggtaaacggttgggggtttacggggtacggggaccggaacggggtacccgtcccggttacggggtaccccgtaaccggttcccgtaccctccggaaccctccccggtaaccccgtaaaccggaaccgggtaccccgtacccggtttccccgggtttccccgtttccccccgggttccggtaccccggtccccgttaccggtcccgtaccggaccggtaccgaccccggtacccgtaccggacggaccgtaccgtaaccggaccggtccccgggtaccgtccgggtccggtaccggtcccgggttacggtaaccggtaaccggttacccttaacccggttacctacggtaccggttaccgttaccggtacggtaccgggtccggggtcggtcgggtaccggaccggtaacgggtcccgtaagacggtaacngngngacg

SEQ ID NO: 267641 - DNA, 719 bp, Homo sapiens
  misc_feature: GYAE6OF01B2KJA.28.57.F02.1.454.CMB.1.raw
  modified_base (294)..(294): a, c, t, g, unknown or other
  misc_feature (294)..(294): n is a, c, g, or t
  modified_base (437)..(437): a, c, t, g, unknown or other
  misc_feature (437)..(437): n is a, c, g, or t
  modified_base (467)..(467): a, c, t, g, unknown or other
  misc_feature (467)..(467): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacgggtaggtttgggctgagtcgttgggtttttccttggttgtcttaagtttttaaagggtgtccagtgtggaggtgcagcgtgggtggagtcggtgggggagtcgttcggccgaggtccggtcggggggtccctgacgtactcctcgtgtcgcgacgtccttcgnggtacttcctaccttacgtagtttatttacgtcgtacttagtcgtaccgtcggtccggggtcccgaccgtacggccgtaccgggaggggacggtacgtagtacgtatagtcgtacgtaagttagtaagtatacgtgaactaanatatatatatacgaatacgtgtagtaaggngtacgacgttactaccactacgtacccaggaacgtaactaacgtaaccaacgaacgtcgtacttacttactactacgtaaggtcgacgtacgtcgtagagtacggacgagggacgtacggtacgtaggttacgttacgttacggtaggttaggggtaaggggtaagggacggggttaacgggtaaagttaacgggttaaggggttacgggttaagggggttcggggtacccggggtacggggtaaccggggg

SEQ ID NO: 267642 - DNA, 790 bp, Homo sapiens
  misc_feature: GYAE6OF01AVLVX.28.57.F02.1.454.CMB.1.raw
  modified_base (223)..(223): a, c, t, g, unknown or other
  misc_feature (223)..(223): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtcagtgtgaggtgcagctggtggagtcgtgggggagcttggtccngccgtgggggtccctgacgctctcctgtcgcagcctctggattccacctttcagttatttatgacttagttcgctaccggtcgggtcccgaccgacggccttaccggaaggggtaacggggtacgtagggtaaattacgtcgtccttacgtaaggtttacgttaaggaaacgttaagtacggtaaccgtaaaacttaaactaagttaatttaaagtttaacgttacgtaaaccctaaaactttccggtttagggttaaacgggaaacgggggtacctaagggttaacctttacccgtaaccctaacgttaccccgttacccgggaaacgggtaaacccttaaaccgttaacccgaaaaccgtaaaccgtaccgtacgttacgttaaccgtttccgtaacgtaaacggtaccgggactacgtccgtaggacgtaggacgttggaacggtaccgacggttcgttacgttaatacggttacgtcgggttaggggaagggtacgggtacgggacggttaaggttacgggttacgggttaggggttcggggtacggggtaccgggtacgggg

SEQ ID NO: 267643 - DNA, 789 bp, Homo sapiens
  misc_feature: GYAE6OF01BR18Y.28.57.F02.1.454.CMB.1.raw
  modified_base (217)..(217): a, c, t, g, unknown or other
  misc_feature (217)..(217): n is a, c, g, or t
  modified_base (611)..(611): a, c, t, g, unknown or other
  misc_feature (611)..(611): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagcttgggttttccttgttgtcttattttaaaggtgtcagtgtgaggtgcagcgtgggtggagtcggtgggggnggtcgttcggtccgagccggtcgggggtccctgacgtcctccgtcctgtcgcacgccttcgtggtacttcctaccctttcgtaagtttaatttatgtcttagtcgtacgtacggttcgggtcccgaccgacggtcccgtacccggaagggggtaaacggggtacgtaagggtaaagttacgttacggttaccgttaacggttaaggttaaagtttaaaggtaaaacggtttaaagtacggtaaaccgtaaaattaaaaccgttaattaaactttaacgtttaacgtaacgtaaacccttaaactttcgttaaggtaacggaaacggacgtagtaacccgttaccaaccttacgtaccgtaaccggtaacgtaaacctaactaaccaaacgtacncgtacgtagtactacttacgaagtcgacgtcgaccgtagacggtacgtcgtacgacgtacgtacgtagttaacgttgtaaacgttggtcggggtagggaagggtacggtaagggtaaccggttaaggttacgggtaacgggtttaaggggtcggggtaccggggtaacggggaccggg

SEQ ID NO: 267644 - DNA, 931 bp, Homo sapiens
  misc_feature: GYAE6OF01B2YGX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgaggtcgttgggtttttccttgttgtacttagtttttaaaggtgtcctagtggtgaggtgcagtctgggtggtagtcggtggggggagtcgttggtccgacggtccggtcgggggggttcccctaggacgtaccgttccgttcccgttgtacgccgtacggtcccttcggtgggtacttttcccgtaaccccttttacgtaacggtttaattttaagttcggacctttagtcgtacccgtacggttccgggggtccccgccggaccggggtccgtacccgggaagggggtaaacgggtacgttagggtaacttagttaccgtcgttacggtaaggttacttaaggtaaaggttaagtacggtaacgttaaaagtaaacgttaatttaactttagtttaacgtacgtaaaccttaaaccgtttaggtttacggttaagggaaccgggtaacggtaacgtttaccttaacccaacccgtacgttacccgttaaccggaaacgggttaaaccctaaaccggttaaccaaaacggaaccgtaccgttaacgttacgtttacgttaaccgttaacgtaaaggtacgggtacttaaccgggcgtaacggtaacggtcgtaacggtacgggggtaacggaccgttaccggggttactttacggttaaaccctttaaggttacggttacggggtacgggtaaagggtaggggtaccgggtaagggtttaaacgggttacggggtttaacggggttagggggttacggggggttaccggggtccggggtaaaccggggg

SEQ ID NO: 267645 - DNA, 797 bp, Homo sapiens
  misc_feature: GYAE6OF01E23QU.28.57.F02.1.454.CMB.1.raw
  modified_base (223)..(223): a, c, t, g, unknown or other
  misc_feature (223)..(223): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggtttttccttgttgtcttaatttttaaaggtgtccagtgtgaggtgcagcgtgggtggagtcggtggggggnggtcgttcgggtccgacggcccggttggggggtcccctggacgtacccttccgtcgtgtcgacgtccgtccgtcggtacgttaccttaccttaccttacgttagtttattagtcgtactacgtcgtacgtccgggtccggtcccgacggacggtacccggtaaccggggaaggggaacggttacggtaagttaacgttacgtacgtttacgtaaggttaaggttaaagttaaaggtaaaggtaagtaacggtaaacgtaaacttaaattaagttaatttaagtttacgaactaactaacgttcggttaggaaggaacgtagtacttacctacccactaccgttaccgaacgggtaactaaacctaacgtaacgaaaccaccgtctaagttacgttactaacgtaacgtaggcgacgtccgtaggtagacgtactaggtacggaccgaacgttagagtttattacgtaaacggtttggggaagggtacgggtaaggtacggggtaacggtaaagggttacggttaacggggtttaacggggttagggggtccgggacggggtacggtaccggggg

SEQ ID NO: 267646 - DNA, 805 bp, Homo sapiens
  misc_feature: GYAE6OF01C9R4L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggtttttccttgttgtctttaagtttttaaaggtgtccaggtgtgaggtgcgagtcgttgggtagggtacggttcggtaggggggacgtccgttcgggtacccgaggtccgggttcggggggtaaccctggaacgtccttcctccgtgtacgcgacgtccttacggtaggtacttcctacctttcgtagtttattatgtcttagtgactcggtcggtccgtaccgacggtcgtaccgggaagggaggtactagggtaactgttgttaccgtagtaacggttaataagtaaagttagagtaaacgtaaataaactaattatttaagtactacgaactaccgttgtagggtaaggtacggactaagtaccttaccaaccttacgtacctaacggaacgtaacctaaacgttaccgaaacgtaccgtacgtacgttagtacttacgtaacggttaacggcggtactacggtcccgtaaggtacggagtacgggtggtaaccggggtacgtccggttaggttaacgttacggtttagtaccgggttagggggaccgggttaaagggaaggttaaccggaccggggttttaaagggtaccgggtttaaacgggtttacgggggttacgggggtccggggtaacgggttaaaccccggggg

SEQ ID NO: 267647 - DNA, 902 bp, Homo sapiens
  misc_feature: GYAE6OF01D03UQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgcttaagtttttaaaggtgtccagtgtgaggtgcagtctggtggagtcgtgggggagtcttggtccaggtccggtcggggggtccctgactacgtcctcctgtgcagtcctcgtggtacttcctaccctttcgtaagttatttagtgtacttagtcgtaccgtaccggtcggggtcccgaccgtacgggtacctaccggaagggggaacggtacgtacggtaaatagtcggtactacgtaggttaaagttaaggtaaacgttaagtacgaacgtaaaataaacgtaattaattaactttaaagtaccgtaaacctaaaccgttgttaagggtaagggtaaacgggtaactacggtaactttaacccgaacccttagttaccccgtaacccggtaagggtaaaccttaaaccgttaaaccccgaaaaggtaacccgtaaccggttacgtttaacgttaatttaacccgttaaaacgtaaaggggttccgggaacccttaacgggtacccgttaagggaacggtaccggtaccgttaacgggaacgggtacccgtaacggggttacctttaaagggttaactttaaacggtttaccgggttagggggtaaagggggtaacgggtaaaacggggtaaacgggtttaacccggggtaaaagggttttacccggggttaaaaacgggggttttggggggttaaaccgggttacccggggggtaaccccgggtaacggggggg

SEQ ID NO: 267648 - DNA, 831 bp, Homo sapiens
  misc_feature: GYAE6OF01CYGZ9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggaggtcgttggtccaggccgtggggggtccctgacgactcctcctgtgcagcctcgtggacttccacctttcagttatttatcgtctatcgctacgtcgggtcccgccgacggctccgaaggggacgggactaggtaactgtcgtagtacgtaaggtaacttaggtaaagttaagtgaaccgtaaaattaactaattaattaacgtttataacggaaccctaaaacttcgttacggtaaggaaacggggacttaaggtaacctttaaccaacccgttaaccgttaccgtaaacccggaaacgggtaaacctaaaccgttaaacccgaaacgtaaccgaaccgtcgtttaacgtaactttaccgtttaaacgaacggttacgggaactaaccggttacccgtaaggtaccggtacggtacggttaacgggaaccggaccgttaacgggtacgtttacggttaaacgttttaccggtttaaggttaaggggttacgggggtaaggggtaaacgggttaccgggtaaacggggtttaaagggtttaccggggttaaaaacgggggttttggggggtttaaacggggggtccgggggtaaacccgggggttaaaccgggggg

SEQ ID NO: 267649 - DNA, 1014 bp, Homo sapiens
  misc_feature: GYAE6OF01AQBQY.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagtcgttgggttttccttgttgtacttaagtttttaaaggtgtccgtagtgtaggaggttcgcgagtcgtgggtggtaggtcggtagggggtacgtcggttcggtaccgtacggtccgggtcgggggtccctagacgtacctctacgttgtcgaccgtacgtccttgtagttacttccgtacctttacgtaagtttactttacgtcgtacttacgtcggtaccgtaccggttccgggtcccgaccggtacggtacccgtaaccgggaacgggggaacgggtacgttaacggtaacttacggttacgttaccgttaacggtaacgggtttaaagttaaacggtaaacggttaacgttacggtaaaccgttaaaacttaagtaaacgtttaacgtttaacgttaacgtaacgtaaaccgttaaacgttcggtaaggtacgggtaaacgtaacgtaagtttaacccggttacctaccgttaaaccgttacccgtaacggggaaaacgttaacccgttaaacctaaaccggaaacggtaacccgttagtttaacccgttaacgttaacctttaaccggtaaaccgttagggtacccgtacgtaaaccgggttccgtaaaagggccccggttaaaggtacccgggttaaaacggtcccgggtaacccgggtaacgtttacccgggtaaacgtttttaaacccgtttaaacggggttaccgggttaagggggttaacgggggtttaaaaccccgggtagggggttaaaaccccggttaaagggggtttttaaaaccccggtaaaggggggtttaaccgggggtttacggggggtaaacccggggttcccgggggtaaaccccggggttaaccgggg

SEQ ID NO: 267650 - DNA, 828 bp, Homo sapiens
  misc_feature: GYAE6OF01B3K0G.28.57.F02.1.454.CMB.1.raw
  modified_base (523)..(523): a, c, t, g, unknown or other
  misc_feature (523)..(523): n is a, c, g, or t
  modified_base (722)..(722): a, c, t, g, unknown or other
  misc_feature (722)..(722): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggagtttgggctgagcgttgggttttccttggttgtcttaagtttttaaaggtgtccagttgtggaggtgcgagtcgtgggtggtagtcggtgggggacgtcgttcgggccgtacggtccggttcggggggtaccctggaacgtacccttaccgtcccgtgtcgacgtacgtcccgttcgtacggtacctttacctaccccgtttagaacggttttaatttacgtacggttacctttaacggtcggtacccgttaaccgggttccgggggttccccgtaccccgaacgggtttcccgaacccggggttaaagggggaaaacggggtccgttaagggtaaaatttccggtacgttacgtacgtaaagggtttaatttaacgggaaaacgttagngtaaacgaaaacttaatattaagttaaattcgtaacgacctaaaacttcgtaaggtacggaggacagtactaccaactacgtaccgtacgaacggtactaacttaccgaaagaccgtacgtacttacgtacttctaacgtaacggtcgggactaacgccgtagaacggtccgtacggaacgaaccggtacgaacggttntacggttacttaaggttcggtagggttagggacgggtaaaggcgggtaaagttaagggttaacggtacgggtttaaggggtccggtcgggggacgttaaccggggg

SEQ ID NO: 267651 - DNA, 845 bp, Homo sapiens
  misc_feature: GYAE6OF01BUP5G.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagcgttgggttttcctttgttgtcttaagtttttaaaggtgtccagtgtgaggtgcagtcgtggtggagtcggtgggggagtcgttcggtccagtccggtcgggggtccctgacgtactctcctgcgctacgtcctcgtggtactttccctaccctttcgtaacgtttattttagtcgtaccttagtccgaccgtacggttccggggtccccgaccggtacggtccgtaccgggaaggggaacgggtacgtaggtaattacgtgttacgtacgtaaggttaattaaggaagttaagtacgaacgtaaataaactagtaatttaattacgtacgactaaacgtcgttaggtaaggaacgggtactaacgttaccttacctaacccgtacgttaccccgtaaccggaaacggtaaaccttaaccgttaaaccgaaaccgtaaacccgtacgtttacttaacggtttaacctaccgttaaacgtaacgggtcgggactaaccggtacgtaacggtaacggtaccgtacgtacggggaccgaaccggtaacgggtccgtttaaacgttaacggtttaaaccgttagggagggggttaagggaacgggtaaacggggtaacggtaaacggggttaaacgggtttaacggggttaaacggggttaggggggttttccgggacggggggtaacccgggtaaccggggg

SEQ ID NO: 267652 - DNA, 802 bp, Homo sapiens
  misc_feature: GYAE6OF01EDKZC.28.57.F02.1.454.CMB.1.raw
  modified_base (210)..(210): a, c, t, g, unknown or other
  misc_feature (210)..(210): n is a, c, g, or t
  modified_base (730)..(730): a, c, t, g, unknown or other
  misc_feature (730)..(730): n is a, c, g, or t
  modified_base (740)..(740): a, c, t, g, unknown or other
  misc_feature (740)..(740): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagtcgttggggtttttccttggttgtctttaagtttttaaagggtgtcctaggttggtgtagggtncgagcgttaggtgggaggttcgggtggggggtacggtcgtttacggtccgacgggtcccgggttcgggggggtacccctggaacgtccttcgttcccgtggtcgccgtacgtccttcgtggtaaccttccctaaccgttttcgtaacgtttaattttacgtcggtctttaacgtcgtaccgtaccggtcccggggtacccgacgacggggtaccttacccggggaagggggtaacgggtacgtagggttaattacgttcgttcgtacgttagggttaaacttaaggtaagttaacgtacggacgtaaaactataagttaatttattactacggtacttaaacttcggtaggtaggacggtacttgtacctaacgtacctacggtcctaacggagtaaccgtaacttaacaacgtaacgtcgtacttacgtacttctaagaaggtcggtctaacgcgttaggaagtcgtacggagaccggagtccgtacttattaccggtacgtagggtcggttaaggggnggtaacgggnggttaaacgggtaggttacgggtaagggtccggggtttacgggtcgggttaacggcccgggg

SEQ ID NO: 267653 - DNA, 826 bp, Homo sapiens
  misc_feature: GYAE6OF01EJ5QJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttatttttaaaggtgtccagtgtgaggtgcgagtcgtgggtggagttcggtggggggagcgtttgggtccaggtcccggttcgggggggtccctggacgtaccgtccttccgtggtcgacacggtcccttgtggtcttaccacctttctaaggttattttagtcggtactattcggacctaccggttccgggtccccggccgacgggtccgtacgggtaagggggacgggtacgagggttaacttacgttacgtccctaggtaacggtttaacgttaaggtaaacgtagtacggaaacgtaaactaaagttaactaatttagttaacgcgtaaacctaaaccggttgttaacgggtaaggtaacgggtacgtaagtaactttaccgaacctacgttacccgtaaccgaacgggtaacctaacgtaaaccgaaaccgtaaccgtaccgtacgttacgttaacttacccgttaacgtaaacggttccgggactaccggtaccgttagggacggtacgtacggtaacgggaacggtacccgggaacggttccgtaagtttacgtaacggttttacggtcggggtagggtaacggaggggtacgtacggggttaaaggttacggtacggggttagggttcggggtacggggtccggtaaccgggg

SEQ ID NO: 267654 - DNA, 844 bp, Homo sapiens
  misc_feature: GYAE6OF01CJL7O.28.57.F02.1.454.CMB.1.raw
  modified_base (329)..(329): a, c, t, g, unknown or other
  misc_feature (329)..(329): n is a, c, g, or t
  modified_base (363)..(363): a, c, t, g, unknown or other
  misc_feature (363)..(363): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagtcgttgggttttccttgttgtactttaagtttttaaaggtgtcctagtgtgaggtgcagtcgtgggtggagtcggtgggggagtccgttcggtccaggtcccggtcggggggtccctagtcgtacttccgtccgtgtcgcacgtccgttcgtgtactttcccacctttacgtagttttaattntagtcctagtccgaccgtacggtccggggtcccnccggacggtccgtaaccgggaaggggtaacggtacttaggtaaattcgtcgttaccgttaagtaaggttaagttaaggaaagttaacgtacggtaaacgtaaaacttaaacttaagttaagtttaactttacggtaactaaaccgttaaccgttagtacggtaaaggacgggtaactaacgtacgttaccctaacgtaccgttacgtaaccggtaaacggttaaaccgtaaacctaaccggaaacgtaacctaccgtacgtttaacgtacttaacctaacggtaacgtaccgggctaacggtcgacggtaaggtacgtcgtaacggtacggactaacggttcttaacgttacgtttaacggtaaggggttcgggtaaaggggacgggttaagggtacgggttaacgggttaaacgggtttacgggttaaaacggggtttccggggttaaacggggtccgggggaaccggttaacccggggg

SEQ ID NO: 267655 - DNA, 861 bp, Homo sapiens
  misc_feature: GYAE6OF01ENKR9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagcgtggtgggagtcggtggggggaggtcgttgggtccaggtccggtcgggggggtcccctggacgtacctcctcctggtcgccgacgtcccttcgtggtactttcccaccctttcgtaagttattttatgtacttagtcgctacggtcggggtcccgaccgacgggtccgtaccgggaaggggaacgggtaccgtagggtaattagttcgtacttacgtaaggttaattaaaggaaagttaagtaggaacgtaaaactaaactaagttaagttaatttaacgtacgtaaccttaaaaccgttcggttaaggtaacgggtaaacgggactaagtaaccgttaacctaccctaacgttccgtaacccgggaacggtaaactaaccgttaaccgaaacgtaaccgtaccggtacttacgttacttaccgttaaacgtaaacggtcggaaccgtacggtaccgttagggaacgggtaacggttaccggtaaggaacccgggtaaccggtaccgggttacgtttaacggtttaagttaaacggttttacggggttacgggggttaaggggaacggggtaaagggtacggggtaacgggttaaaacgggttacgggttaaacgggggtttaggggtttacggggggtaccggggtaccggggtaaacccgggggg

SEQ ID NO: 267656 - DNA, 726 bp, Homo sapiens
  misc_feature: GYAE6OF01EVO5J.28.57.F02.1.454.CMB.1.raw
  modified_base (527)..(527): a, c, t, g, unknown or other
  misc_feature (527)..(527): n is a, c, g, or t
  modified_base (672)..(672): a, c, t, g, unknown or other
  misc_feature (672)..(672): n is a, c, g, or t
tcagagtacgctatcacgaccggtgctcgatttagctcgatatagttgggtctgggagaggagccccccgccctgggtttcccaggtgttctcagtttggtgatcagcactgcacacagaagagtcagtaggacggtagtttgggctggagtcgttgggttttccttgttagtcgttaagtttttaaaggtgtcctagttggtgaggtcgcgagtcgtggtcggtagtcggtgggggacgtcgtttcggccgaggtccggtcgggggtccctaggtacgtaccgttcttcccgtgtagccgtacgccccgttagtaggtacttacctacccgtttagtagtttatttacgtcgtactttagtacgccgtacggtccgggtcccgccggaaccggtcctaccgggagggtacggtacgtaggtaatagtcgtacgtagttaacgtaagttaacgtaagttagacggtaactaaacgtaactattaagtttacttacgtacgaacttaacgtcgttaagacggtacggntaacgtactacctactcgtacgtacgagtaacctactacgaaacgacgtacgtaccttagttacgtattacggaattcgggactacggttcgacgtaagcgtaacgcggagtaccggtagtacgttagtaccgtagtttacgggngtaggagtaggaggtagtacgttacgggtagtggttacgggcggtagtaccggg

SEQ ID NO: 267657 - DNA, 990 bp, Homo sapiens
  misc_feature: GYAE6OF01AJ2CR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagtcgttgggttttccttggttgtctttaagtttttaaaggtcgtccgtaggtggtggagggtgcgaggtcgtgggtgggagtcggtggggggagtcgttcgggtcccgtagggtcccgggtcggggggttcccctggaccgtaccttccgtccgttggtcgccgaccggtcctcgtaggtacttccctacctttcgtaagtttactttacgtcggtacttagtccgtaccgttaccgggttccggtccccggtaccgggtaccggtcccggtaaccggggaaacgggggtaaccgggtaacgttaagggtaaatttcggttcggtaacgtttacggtaaaggttaaggttaaagggtaaagttaacggtaacgtaaaccggtaaaaattaaaccggtattttaaacgttaagtttaacgtaaccgtaaactaaacccggtttagggttaacggtaaagggtaaaccggtacttaaacggttacgttaacccctaacccgttacgttaaccccgggtaaccgtaaacggggttaaaccccttaaacgtaaacccggaaaaccttaaccgaccggtttaaaccgtttacgttaaaccgtttacgtaaaccggttaggaccccgggtaacgtccgttaaccggtaggtaacgggaaccggttcggtaacggggtaacccggaacggttccggtaaaccgttaggtttaaaccgttacgggtttaaccgggagggggttaaacgggggaaggttaacgggggaagggttaaacgggtttaacgggttaaacggggttcggggtttaaggggggttccgggtaacgggggaaccccgggttaacgggggg

SEQ ID NO: 267658 - DNA, 787 bp, Homo sapiens
  misc_feature: GYAE6OF01AWMX1.28.57.F02.1.454.CMB.1.raw
tcagagtacgctatcacgaccggtgctcgatttagctcgatatagttgggtctgggagaggagccccccgccctgggtttccccaggtgttctcatttggtgatcagcactgcacacagaagagtcatgacggagtttgggctgagctgggttttccttgttgcttatttttaaaggtgtccagttgtgaggtgcagcgtggtggagtcgtgggggagcttggtccaggccgtggggggtccctgagactcctcctgtgccagcctgtggattccaccttctagttatttagtgtctaatgctacgtcgggtcccgccgacggcctaccggaaggggaaagggtaccgtaggaaatagtcgttactacgtaaggttaatttaaggtaaaagttaaagtacgggtaacgaaaaagtttaaaaccctaaatttaaagttaatttaacgttaagaaccctaaaaccgttaccgtttaggtaagggaacgggtactaagtacttacccaaccttactaccgtaaccgtaacgggtaaactaaacttaaccccgaaacgtaaaccgaaccgtaccgttaacgtactttaaccgtttaacctaaaggtacgggtaccgtacggtaacccgtaggtaacgggtacacggtaggtaacgggaccgggaaccgtacgttaacgtattaacggttaacgtcgggtaaggggttaaggaacgggtagggtaccggttaaaggttaaccgggtaaggtttagggggttacggttacggggggcccggttaaaccggggg

SEQ ID NO: 267659 - DNA, 860 bp, Homo sapiens
  misc_feature: GYAE6OF01CK44U.28.57.F02.1.454.CMB.1.raw
  modified_base (611)..(611): a, c, t, g, unknown or other
  misc_feature (611)..(611): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttggtttgtctttaagtttttaaaggtcgtaccaggttggtggaggtgcgaggtcgttgggtggtacggttcggtggggggcgtcgttcggtccgaggtcccggtcggggggtccctggacgtcctccgtcctggtacgccgacgtccgtcgtcggtacttcctaccttaggatttattagtccgtacttagtcgtacgttaccggtcgggacccgtccggaacggtccgtaccggaaggggtacggacgtaggtaactgtcgtactacgtaggttattaaaggacgtagtacgaataactaaagtacttaagtactacgtacgtaactaaggtttcgtacgtaacggggtaacgtacggttaactcttaacccgtaccgtacgttaccccgggaaacgtaaacgggttaaaacttaacccgttaacccgaaaacgtcccggtttaaacgggtnttttaaacccggtacctttaaccgtttaaacgggccgggttaaaccgggtctaaaccgacgggtttaaaccggagttacccggtaaccggttaaggggaaacccggtcttaaaaacccgggtttttaaaccggttagttaacgggtttcgggaaacgggtaggggaacgggtacgggttaacggttaaacggttagggttaaacgggtacggggtttagggaaccggggttacgggtacccggggaccc

SEQ ID NO: 267660 - DNA, 851 bp, Homo sapiens
  misc_feature: GYAE6OF01CQW8T.28.57.F02.1.454.CMB.1.raw
  modified_base (680)..(680): a, c, t, g, unknown or other
  misc_feature (680)..(680): n is a, c, g, or t
  modified_base (736)..(736): a, c, t, g, unknown or other
  misc_feature (736)..(736): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctgagcttgggttttccttgttgtcttaagtttttaaaggtgtccagtgtgaggtgcagcgtggtggaggtcgtgggggaggtcgttggtccagccggtcgggggtccctgacgactctcctgtgcacgtcctcgtggtactttcctacctttcgtaagtttaattttagtcgtacttagtcggtccgtaccggttcggggtccccgaccggtacgggtccgtacccgggaaaggggggtaaacgggtaccggtaagggtaagttagttacggttaccgttacggtaaggtttaagtttaaacggtaaagttaacgtacgggaaaccgttaaaataaacgtaatttaaatttaacgtttaagtaacgtaaaccgtaaacctttacggttaggtaagggtaacgggtactaaggtacccgtttaccacccgtaactttccgacccgaaaggtaacctaacgttaaccaacggtaccacggttacttacggtacttacgttaaacgaagggtccgacgaccggcctaagggaagaccggtnttaacggggaccgtaccggtacggttacttaggttaaagtttcgtttaaacggggnggggttaagggggaacggtaaacgggggtaccggttaaacggggttaaagtttaacgggggtaaggggttttggggggtttaaccggggaccggggggtacccgaaaccgggggg

SEQ ID NO: 267661 - DNA, 887 bp, Homo sapiens
  misc_feature: GYAE6OF01DW03V.28.57.F02.1.454.CMB.1.raw
  modified_base (151)..(151): a, c, t, g, unknown or other
  misc_feature (151)..(151): n is a, c, g, or t
  modified_base (221)..(221): a, c, t, g, unknown or other
  misc_feature (221)..(221): n is a, c, g, or t
tcagagtacgctatcacgaccggtgctcgatttagctcgatatagttgggtctgggagaggagccccccgcccctgggtttccccaggtgttctcatttggtgatcagcactgcacacagaagagtcatggacggtaggtttgggctaggngtcgttgggtttttcccttggttgtacgtttaagtttttaaaggtcgtccgaagttgtggaggtgcgagngtggtcggagttcggtaggggacgtcgttacggaccgtcggtcccgggttccggggggttaccctcggtaacgtcccgttcccgttacccgtgggtcgaccgacgtcccgttacggttacggtacctttcccgtaccttttacggaattttaacgtttagtacggtactttacggcgtaccggtaccggtccgggggttaccccgacggtaccgggtacccggttaaccggaagggggtaaacgggtaccgttaagggtaaacgttacgtaccggtttaccgaagggtttaacggttaaaggttaaagtaaaccggtttaaagaaccggtaaacgttaaaaacttaaagtacgttaaaacgtttaattacggtttaacaaacctttacggtcgttaacgggttaaaggacgttacgtaacgtaaccttacccgaaccgttaactaccgtaacccgtaaggtaacctaaacgtaccgaaacgacccgttagtacgtgtaacgtacgttaacgtaagtcggaacgtagtacgaggtaccgaacgtaggtacggacgtaccggagttaccgtagtaacgttaggtaaccggtggggtacggtaggtacggtaacggtaaggtttacgtaacgggttaggtcgggttacgggaccgggtacggtaccggg

SEQ ID NO: 267662 - DNA, 789 bp, Homo sapiens
  misc_feature: GYAE6OF01EYFFT.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgcacacagaagagtcatgacggtagtttggctgagtcgttgggtttttccttggttgtacgtttaagttttttaaaggtcgttaccgagttggtggaaggtcgcgagtcgtgggtggtacggttcgggtggggggacggtcgtttcgggtccgacggtccgggttcggggggtcccctaggacgtaccgttccgttccgtggtcgccgtacgtcccgttcgttacggtaccttacccgttaacccgtttacgttaaggttttacttttacgtcggtaccttaagtcgtacccgtacggttcccggggtcccgaccgtacggtacccgtacgggaacggggtaacggtacggtaggtaacttacgttcgtacgtagtaagttaagtaagtaagttagcgtaaacgaaatataattataattacgtacgattaaacgtgtaggtacggacggtactacgtctacctacctacgtacctaacggacgtaactaacgtacaaacgtacgtactacgttataaccttacgtaagtacggcgacctagtacgtagtaggacgtagtacgggacgtacgtacggtactagtttaacgtagttaggtgggtaacgggaggtaacgggtacgtaacgggttaaggtacgggttaacggttaggggttacgggacggggcggtacgggg

SEQ ID NO: 267663 - DNA, 803 bp, Homo sapiens
  misc_feature: GYAE6OF01EXCWM.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatggacgggtagttgggctggagtcgttgggtttttccttggttgtactttaagttttttaaagggtgtacccgtaggttggtggaggtcgtaccgaggtgtgggtagggacggttcgggtaggggggtggtaccgtttcgggccgaccgggtcccgggttccgggggggtaccccctagggaaccggtccctcccgttcccgttggacgccgtacggtacccttggtacggttaccttcccgtaccttacgtaagttaatttacggtctactagtcgaccgtacggttcccggggtacccgaccgtacggtcccgtaaccggggtaagggaacgggtacgtaggtaacttacgttgttactacgtaaggtacttaagaagtatagaactaatacattatagtaagctaactaacttcgtaggtacgtaaggcttaacgtacacctacgctacgtaccgaacgtaacaacgttaacgaacgtaacgtacctagtacttacgttctaaagtaacggtaccgacgtacgtcgtacgagggttacggactaaggtccgggtaacaccgggttgtaaggttattaacgggttagtcgggaaggttacgggaaggttaacgggtacgtaaagggggttaccgttaaggggtaagggttcggggaccggggtacgggtaaccgg

SEQ ID NO: 267664 - DNA, 772 bp, Homo sapiens
  misc_feature: GYAE6OF01ALWM9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggtttttccttgttgtacttaagtttttaaaggtgtcctagtgtggaggtgcgagtcgtgggtggaggttcggtagggggaggtcgttcggtccgtacggtcccgggttcggggggttccctggacgtaccttccgtccgtggtcgcgtaccgtcctcgtggtaccttacctaccgttactaggtttaatttagtgtctatcgtctccggtcggtcccgccgtcggtaccgtaccggaaggggaacggtacgtaggtaattgtcgtacgtacgtaggttaacgtaaggtaagtagtaacgtaacgtaaactaaacttaattaattaagttactaacgtaactaacttacgtaggtaagggacggtactaagttacctaaccgaccttaccgttaaccgaccggtaaacggtaaaccgtaaccgtaaaccgtaacgaaccgtacgtacttacgtactacgtaagacggtcgagtacgtacgtagagacgtacgtacgacgacgtcgagtttactagttacgttacggtgggtagggtaaggaacgggttaacgggtaagttaaacggggttacgggttaaccggggttagggtaaccgggggtggggtaaacccgggtacggg

SEQ ID NO: 267665 - DNA, 919 bp, Homo sapiens
  misc_feature: GYAE6OF01A9SFW.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctggagtcttgggttttccttgttgtcttaagtttttaaggcgtcctagtgtgaggtgcagcgtgggtggagttcggtgggggagtcgttggccgtacggtccgggtcgggggttccctaggtacgtacctcgttccgtggtcgaccgtacgtccgttcgtaggtacttaccgtaccgtttataagtttaactttagtcgtactagtcgtacgtacggttccgggtcccgacgtacgggtcccgtaacggggaacggggtaacggtaacggttaggtaagttacgttcgttacgtacggtaaggttaagttaaggtaaagtacgtaacggaacgtaaaactaataaagtttaagttaacgttaagtacgtaaaccgtaagttacggtaacggtaaggtaaaccggtacgttaaacgtaacgttaacgtaacgttacgtaaccgttacccggtaaaccggtaaacgggtaaaccgttaaacgttaaacccgtaaaaccggttaaccgtaaccgttaccgttaacggtttaaccttaaccggtttaaaccgtaacgggttaacggtaccgtaaccggtaccggtacggtaacggtacgttaaccggtaagggtaaccggtacccgggttaacggttaccggttaaacgtttaaacgttaacggtttaacgggtacggggtttaaggggaacgggttaaaggggtaaccggtaaagggtttaacgggtaaccgggttaaggggttaaccgggggttaggggtaccgggggtaacccggggg

SEQ ID NO: 267666 - DNA, 860 bp, Homo sapiens
  misc_feature: GYAE6OF01DUN9W.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcagtgacggtagtttgggctgagtcgttggttttccttgttagtctttaagtttttaaggtgtcgagtgtagtaggtgcgagtcgtggtggagtcggtggggacgtcgttcggtaccgtacggtcccgggttcggggggttccctaggtacgtaccgttcccgttccgttcggtcgaccgtaccgttccgttcggtacggttaccgtttaccttacccgtttagttaagttttactttatccgtatacgtccgtaccgtaccgggttcgggtaccccaccggtaccggtacccgttaaccggggaagggtaacggtaaccgttaaggtaacgttacgttccgttacgttacgttaaaggttaagtttaaacggtaaagttaacgttaccggaaacgtttaaaacttaaactaagtttaacgttacgtttaacgtaccgtaacgtaaacgtttcggaaggttacggtaacggtacgttacgtaccctttacccgaacgttaccgtacggaaaccccgggttaagtaacctaaaccttaccgaaaggtcctacgttcgttagttacctacgttaagacgtacggacgttaccgtggaacggacggtaaccgacggtacggaacgtacgtccggttaatttagtagttaaccggttagggcggtaagggtacggaaggtaccggttaaggtaacgggtttacgggagggtttacgggtccggggacgtaggggtacccg

SEQ ID NO: 267667 - DNA, 764 bp, Homo sapiens
  misc_feature: GYAE6OF01BC1QL.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgcacacagaagagtcatgacggagtttgggttgagcgttgggtttttccttgttgcttattttaaaggtgtccagtgtgaggtgcagcgtggtggagtcggtgggggaggtcttggtccgaggccggttcggggggtccctggacgtacttcctccgtgtcgcagtcctcgtggtactttcctacctttcgtagtttactttagtgtacttatcgtcgtaccggtcggggtccccgtaccggacggtccgtaccgggaagggggaacgggtacgttagggaattacgttcggtacttacggtaaggtttaagttaaaggtaaagttaagcggtaaacgtaaactaaactaattaattaagttactacggtaactaacgttcgtaggtaggaacgggatacgtacttaccgactacgtaccgtaaccggaggtaaaccttacgtaacgaaaccgacgtaacctgttaacgttactaacgttaacgtacggtcggaacctacggtcgtaaggacgcgttaaggtacggacggtactacgggtacgttcgtaaattcggttaacggtgggtaacggtaagggacggtacgggttacgtaaggttaacgggtacgggtttggggtaaccggggacgggaccggtaagggggtaccccg

SEQ ID NO: 267668 - DNA, 823 bp, Homo sapiens
  misc_feature: GYAE6OF01B611C.28.57.F02.1.454.CMB.1.raw
  modified_base (227)..(227): a, c, t, g, unknown or other
  misc_feature (227)..(227): n is a, c, g, or t
tcagagtacgctatcacgaccggtgctcgatttagctcgatatagttgggtctgggagaggagcccccgccctgggtttcccaggtgttctcattttggtgatcagcactgcacacagaagagtcatgacgggtagtttgggctgagcgttgggtttttccttgttgtcttaagtttttaaaggtgtaccagtgtgaggtgctagcgtggtggagtcggtagggggnggtcgttcgggtacccgagtcccggtcgggggggttaccccttggaacggtacccttcctcccgtggtcgacgacggcccttacgtggtactttcctaaccttttctagtttaatttacttcgtacctatcggtcctaccggttcggggtcccgccgtaggccgtaccggaaggggaacggtacggtaggtaaagttcgttgtacgttacgtaaggttaattaaggaagttaaacgtaggaacgtaaataaactaatttaagtttaattacgtacgtaacgtaactttccggttaggacggtaaacgggtacgtaaggtacttaacccgaccgttaaccgtaccggttaaccgaaccgggtaaaccttaaaccgttaaccgaaacgtaacgaccgttacgttacttacgttaacttaacgtaacggtccgggaacgtccgtaaccgtacggaaggtacgtccggtaagaaccggtacgtaccgtagttaagttacgttaacggtagtcggggtaggtaacgggtaaggacgggttaaggttaaacgttaacgggttacggttaggggttacggggtacgggtccgggtaaccgggg

SEQ ID NO: 267669 - DNA, 801 bp, Homo sapiens
  misc_feature: GYAE6OF01CLUT4.28.57.F02.1.454.CMB.1.raw
  modified_base (213)..(213): a, c, t, g, unknown or other
  misc_feature (213)..(213): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtccagtgtgaggtgcagcgtggtggagtcgngggggagcgttcggtccacggtccggtcggggggtcccctggacgtacctccgtcctggtcgcacgtccgtcgtggtactttcccacctttacaagtttattttatggtcctagtcggtacctacggtccggggtcccgacccgtacggcctcccgggaaggggaacgggtctaaggggaattagtcgtctacgaaggttacgttaaggaaagttaatgaacgtaaaataaacgtacttaattaattaacgtcgtaaacctaaaccgttcggtaggttaggaacggggtacctaaggtaacttccaaacccgtcgttacccgtaacccggaaggtaaccgttaacttaaacccggaaagtaacccgtaacgtacttcgttaactaccgtttaaacgaacgtcgggtaacgacgtaccgtaggacgtacgacggttacgaacggtccggaaccgttgtacggttaaacttacgttaacgggtacgggtaggggaaggggtacgggtaacggtaaggggttaaaccggttaacggggtaaacggggtttacggggtttacggggcccggggggtaccggtaacccggggg

SEQ ID NO: 267670 - DNA, 839 bp, Homo sapiens
  misc_feature: GYAE6OF01BTYAF.28.57.F02.1.454.CMB.1.raw
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
  modified_base (795)..(795): a, c, t, g, unknown or other
  misc_feature (795)..(795): n is a, c, g, or t
tcagagtacgctatcacgaccggtgctcgatttagctcgatatagttgggtctgggagaggagcccccgccctgggtttcccaggtgttctcatttggtgatccagcactgcagacagaagagtcatgacgggtagtttgggctgagcgttgggttttccttgttgtcttaagttttaaaggtgtccaggttgtgaggtcgcgagtcgtggtaggngtcggtgggggagtcgttggccgaggccggtcgggggtaccctggacgtcctcgtccgtagtcgcgacgtccgtgtcggtactttcctaccgttntaagtttaatttaacgtggtaccttacgtcggtaccgtaccggttcgggggtaccccacggtacgggttacccgtacccggggaagggggtaaaacgggttccgttaagggtaaaacttacgggtttccgttaacgttaccgggtaaaagggttttaagtttaaaaggtaaaacggtttaagttaaccggaaacggttaaaaattaaacccgttaaaggttaaattttaaacgttaaggtttaccgaaaacccttaaaacgtttccggttaaaggtaagggtaaacgggtacctaacggtttaaccttacccggaaccttacggtacccccgtacggaaacggtaacctaacgttaaccgaaaggtaaccctacgtattaccgtactacgtaacgtaacggcgacgttacgaccgtggacgagtacgacggtaacggagtaccggtagttatacgttagtcgggtaggtaggaaggcggtaagnggttaaggtacgggtaggttagggcggtcggggacttaacgggg

SEQ ID NO: 267671 - DNA, 791 bp, Homo sapiens
  misc_feature: GYAE6OF01A14MB.28.57.F02.1.454.CMB.1.raw
  modified_base (181)..(181): a, c, t, g, unknown or other
  misc_feature (181)..(181): n is a, c, g, or t
  modified_base (196)..(196): a, c, t, g, unknown or other
  misc_feature (196)..(196): n is a, c, g, or t
  modified_base (315)..(315): a, c, t, g, unknown or other
  misc_feature (315)..(315): n is a, c, g, or t
  modified_base (564)..(564): a, c, t, g, unknown or other
  misc_feature (564)..(564): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcagtgacggagtttgggctgagtcttgggttttccttgttgcttagtttttaaaggngtccagtgtgaggtncagcgtggtggtagtcgtgggggagtcgttcggtaccaggtccggtgggggttccctgagaccgttctccgttgtagtcacgtcctcgtggtacttcctaaccttcgtagttatttagngtcctagtcgctaccggtcggtacccgccgaggtccctccgggaaaggggtaacggtaccgttaggtaaatttcgaggtaccttacgtaaaggttagttaaagaacgtagtacgtaaccgaaaattacaagttaatttctaacgtacgtaaaccgtaaacttcgttagggaaacggtaaggtactaaacgtcttaaccctaacgtattaccccggaagttaacggaaaccttaacctaaaccggtaaanaaccggtcgttactaagtaacctttaccaaacggtaatccgggacttaacgcccgtaaggaccgttagtaaccggtggtaaacccggattaccgggtactacgtttaaacgttaccgtttaaaggggcggttaaacggggaggtaaacccggtaggtaaaccgggtttaacgggttaacggtaacgggtttaggggtccgggttaacgggtcccggggtaaacgggg

SEQ ID NO: 267672 - DNA, 733 bp, Homo sapiens
  misc_feature: GYAE6OF01AV9FP.28.57.F02.1.454.CMB.1.raw
  modified_base (180)..(180): a, c, t, g, unknown or other
  misc_feature (180)..(180): n is a, c, g, or t
  modified_base (205)..(205): a, c, t, g, unknown or other
  misc_feature (205)..(205): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttaatttttaaacggngtccagtgtgagtgcagctggtggngtcgtgggggagcgttcggccgacgccggttgggggtccctgagacctcgtcctgtgcacgtcctgtagtacttcctaccttctattattatgactatcgcgtacggtccggtacccgccgaggccgtaccggaacggggaacggtacgttaggaatagtcggtacttacggaaaggttaattaaaggaagttaaacgtagaaacgtaaaacgttaaaatattaaattaacgttaagtacgaaccttaaaacgtcgtaaggtaacgtacgggaactacgtaacgttaccaacctacgtacccgtaacgtaaacggaacttaactaacgaaacgaaccgtaacgtcttaacgtactagttaacaacgtggaccgacgttaccgaagtacggtaacgcgtaaggaacccgtacggaacgtacttaggttaacttaacgttacggtaggggtaaggacgggtaaagggcgtaaagggttaaacggtgggtaaacggtttaggggttccgggaacggggaccgggtaccggg

SEQ ID NO: 267673 - DNA, 825 bp, Homo sapiens
  misc_feature: GYAE6OF01ENJOW.28.57.F02.1.454.CMB.1.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggnggcttggtccagtccgtgggggtccctgataccgtctcctgtgcacgcctctggtattcacccttctagttatttagtgtctatgaccgacgtcgggtccnccgaggtcctaccggaaggggaacgggtacgtaggtaagtattcgtactacgtaggtaagttaagtaaagtaagtacgaacgtaaaataaacgtaagttaattaatttacgtacgtaacgtaaacgttcgtaggtaaggaacgggtacgtagtaacgttaccacccgtacgtaccgttaaccgggtaacgggtaaacccttaaacgttaacccgtaaaaccggaaacccgtaccgttaccgttacgtttaacgttaccgtttaaacgaaacggttacgggaccgtaacggtaccccggttggaaacggtacgtaaccgggttacggaaccggtaaacgggttccgggaacgtttagttaaccgtttaaacggtttccggttaaggggttaacggggttaaacgggaacggggttaacgggtaaaccgggtttaaaaggggttacggggttaaacggggtttacggggggttttcgggggtaccggggggtacccgggttaaaccgggggg

SEQ ID NO: 267674 - DNA, 768 bp, Homo sapiens
  misc_feature: GYAE6OF01CPA4Y.28.57.F02.1.454.CMB.1.raw
  modified_base (181)..(181): a, c, t, g, unknown or other
  misc_feature (181)..(181): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatggacggagtttgggctgagtcgttgggttttccttgttgcttaatttttaaaggngtccagttgtggaggtgcagcgttgggtagggagtcggtggggggaggtccgtttcgggtccgacggccggtcggggggttccctggaacgtccttccgtccgtggtacgccgtacgtcccgttcgtagggtactttacctacccgtttctaacggtttatttacgtgtaccttatcggacctacggtcggggtccccgccgtaacggcccgtaccgggaaggggaaacggacgtaggtaattagtcgtacctagtaaggtaagttaagaagtaactagaacgaaataacgtaattattaattcgagtaactaaagtcgtaggtacggaaggctagtacttaccgactacgtacgacccgaagtaacctaacgtaaccgaaagaaccgtagtaccgttagttacgttacctaacgtaaagggtccggaactaccggtacccgtaggacggtacgtaccggtaggaaccggtaacggccggttatacgggttattacgttaacgggtgggtaagggtagggagggtacggtaagggtacggttaacggggtaggttaggggttagggtaccgggtacgggtaccgggg

SEQ ID NO: 267675 - DNA, 742 bp, Homo sapiens
  misc_feature: GYAE6OF01B0GP2.28.57.F02.1.454.CMB.1.raw
  modified_base (207)..(207): a, c, t, g, unknown or other
  misc_feature (207)..(207): n is a, c, g, or t
  modified_base (279)..(279): a, c, t, g, unknown or other
  misc_feature (279)..(279): n is a, c, g, or t
  modified_base (482)..(482): a, c, t, g, unknown or other
  misc_feature (482)..(482): n is a, c, g, or t
  modified_base (671)..(671): a, c, t, g, unknown or other
  misc_feature (671)..(671): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagtcgttggttttctgttgtcgttaattttaaggtgtcagtgtgagtgcagtcgtggtacggngttcggtggggtagtcgtttcggtaccagggtcccggttcgggggttaccctgaacgttccttccgtccgtntacggctacggtccccgttgtagtaactttcccgtaaccttacgttagtttaactttagtcctacgtagttccgtaccgtaccggtcggggtccccgccggtaccggcccggtaccgggaagggacggtacgtaggttaatcggttacgttactacgggtaattaagttaaggtaagacgtacgtaaagtaaactaaacgttnttaaaacgttgtaactaaccggtaattaaaccgttgtaaggtaccggtaaagtcgtaacgttactacgaaccttcgttacccgacgtagtaaaccacgtacaacgtactcgttagtctaacgtctagaggtcgtacacgagtacgtaagcgtacgaaggtaccggcgtatacggtttatacgttacggnggttaggaagggtgaacgtgggttagtacgggtacggtacggttaggggcggtaacgggtcccgggtaggg

SEQ ID NO: 267676 - DNA, 783 bp, Homo sapiens
  misc_feature: GYAE6OF01CCW88.28.57.F02.1.454.CMB.1.raw
  modified_base (615)..(615): a, c, t, g, unknown or other
  misc_feature (615)..(615): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttggttgtcttaagtttttaaagggtcgttaccagttggtggaggtgcgagtcgtgggtggagttcggtgggggtagtcgttggtccgacggtccggtcggggggtccctggaacgtccttcctccgtgtcgcgtacgtcccttggtagtacctttcctaccctttgtaagtttatttaagtcgtaccttagtcgtaccgtacgggtccggggtcccgaccggaggtcccgtaccgggaaggggaacggtcgtaaggtaaactgttcgtactaggttaaggttaattaaggaaagttagtacgaactaaataactattaacttatactacgaactaacgtgtaggtaggacgactacgtacttacacctatacccgtagaacggtactaacgtaacgaacgtacctacgtcgttaactacgttactaacgaagtccggacgtaacgtccgtaagngtaccgaggttacggaaccgtaggtacccggtaattaggttaaacttacggttacgggtaacggggttaggggaacggtaacgggttaaccgggtaagggtttaaggttaacggggtaaagggtttaccgggggtacggggtacgggggtaacccggggtaaccgggg

SEQ ID NO: 267677 - DNA, 917 bp, Homo sapiens
  misc_feature: GYAE6OF01CLNOJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagcgtggtggagtcgtgggggaggtcgttggtccgagtccgtgggggttccctgacgactctcctgtcgcacgcctcgtaggtacttcctaccttcgtaagtttattttagttcggtcttaagtcggtccgtaccggttccgggggtccccgacccggtacgggtcccgttacccgggaaggggggtaaaccggtacgtaggggtaaacttagttacgggtttcctacggtaagggtttaaagttaaacggtaaaaggtttaaacgtacggtaaacgtaaaacttaaaacgttaagtttaaacttttaatttaaacgtcgtaaaacgttaaaaccctacggtttaggtaaacgggaacgggtacgtaaacggtttaacttacccgaaaccccgttagttaccccgtaacccgggtaaacgggtaaaccgttaaacgttaacccgaaaacggtacctaaccgttacgttacgtttaaccttaacgttaacctaaagggttcgggaaccgtaccgttacgtaacggtaacggtacgttacggaagggtaaccggtacccggtaaacggttccgtttaaaggtaaccgttaaggttttacgggttaacggggtaagggggttaacgggaaggggtaaccggggtaaagggttaacggtttaacggggttaaaacggggtttacggggggttacgggtaccggggggttaccccggggaaccggggg

SEQ ID NO: 267678 - DNA, 968 bp, Homo sapiens
  misc_feature: GYAE6OF01AFERU.28.57.F02.1.454.CMB.1.raw
  modified_base (225)..(225): a, c, t, g, unknown or other
  misc_feature (225)..(225): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtgtttgggctgagtcgttgggttttccttgttgtactttaagttttaaaggtgtccgagtgtggaggtgcagtcgtggtggtacgtggtggggngtccgttacggtccgacggtccgggttcggggggtccctaggtaccgtaccttccgtccgtgtacgccacgtccgttcgtaggtaccttccgtaccttgttaacgtttagttgtcgtacttacgtcgtactacggttcgtccgtcccggtaccgtacggtacccgtaccggggaaggggtaacgtcggtaaggttaacttacgtccgtcgtaacgttaaggttaagttaaggtaacgttaacgtcgtaaacgtaaacgtaacttaattaacgtttaacgttacgtaacgttaaacccgtaaaccgtttggtaacggtacgggttaacggaacgtaccggtttaacgtaacccgtaacccggttaccgttaacccgggtaacccggtaaacgtaacccgttaaaacccgttaaccggaaaccgttaaccggtttaccgtaccgttttaaagttaaccctacccggtttaaaggacgggttacccgggacctttaacgggaccggttaacggggtacggtaaaacccgtcgggtttaaaacccggggacccgttaccggttaaacccggttcggttttaaaccggttaacgggtttaacccggggttaaggggtttacgggggaaaacggggtttacggggaaaccccggggttagggggtttaaacccggtttaacgggggttaacggggggttaaccgggttttcgggggggtaaccccgggtttacggggaaccccgggggg

SEQ ID NO: 267679 - DNA, 796 bp, Homo sapiens
  misc_feature: GYAE6OF01CYYZT.28.57.F02.1.454.CMB.1.raw
  modified_base (101)..(101): a, c, t, g, unknown or other
  misc_feature (101)..(101): n is a, c, g, or t
  modified_base (142)..(142): a, c, t, g, unknown or other
  misc_feature (142)..(142): n is a, c, g, or t
  modified_base (240)..(240): a, c, t, g, unknown or other
  misc_feature (240)..(240): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (357)..(357): a, c, t, g, unknown or other
  misc_feature (357)..(357): n is a, c, g, or t
  modified_base (413)..(413): a, c, t, g, unknown or other
  misc_feature (413)..(413): n is a, c, g, or t
  modified_base (438)..(438): a, c, t, g, unknown or other
  misc_feature (438)..(438): n is a, c, g, or t
  modified_base (558)..(558): a, c, t, g, unknown or other
  misc_feature (558)..(558): n is a, c, g, or t
tcagagtacgctatcacgaccggtgctcgatttagctcgatatagttgggtcgtgggagaggacgcccccgcctgggtttcccaggtgttctcatttggtnatcagcactgcacacagacgagtcatgacggtgttggctgngtcgttggttttccgttgttgtacgttaagtttttaaacggtcgtaccgtaggtggtagtaggtcgcgtacggtcggttgggtgggtacggttcgggnggggggtacgtccggttcggtcccgaacggtccgggttccgggggttaccctgtaacgtccttccgttccgtggtcggcacgtctcgtgtacttctactagacgtttntatcgntancgtacgcgtcggcccacgcgtaccgtacgggaagggtacgtacgtaggtactagtntcgtaagtaggtaagtacagtaacngtaacgtaatacagttaactagtacgtaacgtaacctgttaacggagtaggtacgactacgtactaccgtactaccggagtaacccgtaagtaaccgtaacgtaaacgtacgtaaccgtnttaacgtactaaaccgtttacggaagtaccggtctacgggaacctcgtaggtaactacgtccgaacgggtaaccgtacgggtaaacgtggtttaaaaccgtaggtttaacgggacgggttaaacgggtggggtaaacgttaaacgggggtcgtttaaaccggggtacgggtttaaaaccggggtacggggtttacggggaaccggggtttaccccgggggaagtttaaccccgggggg

SEQ ID NO: 267680 - DNA, 637 bp, Homo sapiens
  misc_feature: GYAE6OF01DTVHF.28.57.F02.1.454.CMB.1.raw
  modified_base (194)..(194): a, c, t, g, unknown or other
  misc_feature (194)..(194): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (242)..(242): a, c, t, g, unknown or other
  misc_feature (242)..(242): n is a, c, g, or t
  modified_base (293)..(293): a, c, t, g, unknown or other
  misc_feature (293)..(293): n is a, c, g, or t
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
  modified_base (499)..(499): a, c, t, g, unknown or other
  misc_feature (499)..(499): n is a, c, g, or t
  modified_base (517)..(517): a, c, t, g, unknown or other
  misc_feature (517)..(517): n is a, c, g, or t
  modified_base (529)..(529): a, c, t, g, unknown or other
  misc_feature (529)..(529): n is a, c, g, or t
  modified_base (576)..(576): a, c, t, g, unknown or other
  misc_feature (576)..(576): n is a, c, g, or t
  modified_base (587)..(587): a, c, t, g, unknown or other
  misc_feature (587)..(587): n is a, c, g, or t
  modified_base (628)..(628): a, c, t, g, unknown or other
  misc_feature (628)..(628): n is a, c, g, or t
tcagagtacgctatcacgaccggtgctcgatttagctcgatatagttgggtctgggagaggagccccccgccctgggtttcccaggtgttctcatttggtgatcagcactgcacacaagaagagtcatgacgggtagtttgggctgaggcggttggtttcgtgtaggcttagtttaaagtgtcagtgtgaggtncngcgtggngacgtggtgggcgtgtcgctaggtccggtgggtccaggntctcgtcgtgcgcgcgtcttcgagtcctactaccggttatagtttatcgtntctcgtcacgtccgtcgggcccaggtacgtcccggnggggaaacggttagtcggtaagtntaacgtcgtacgtaggtaagttaagttagaaccgttagtaccgaagtaaacctatattaagttacntacggacaaattcgaaggtcaaggttacatactacgtactactcgtaaggctaacactaacgaacgtactcgtatacgtntaccgtagagccgtaacncggtacgtacgngtaccggacgtagaacggaccgtacgttcggtataggttacgtaggnggttacgaggnggtcggtaaagtcggtaaacggtggtagggttcggacgggnggtaccggg

SEQ ID NO: 267681 - DNA, 735 bp, Homo sapiens
  misc_feature: GYAE6OF01EHJI4.28.57.F02.1.454.CMB.1.raw
  modified_base (210)..(210): a, c, t, g, unknown or other
  misc_feature (210)..(210): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtcagtgtgaggtgcagctggtggagtcgtgggggngcgttggcccagccgtgggggtccctgagtctctccgtgtcgcagtcctctggtattaccaccttcgtagttaactttatggactagtcgctacgtcgggtcccgccgacgggtctccggaagggagggtacgtacggaaatagtgtactgtaacggtgttaaggaagtagtacggaccgaaataacgtagtaattagttactagaacctaaactcgtagtacggaaaggctaagtcttacccgaaacctgtacccgtacccggtaaggtaaaccctaacgtaccgaaacgaaccgaacggtccttagtacttaaccgttacgtaaacggtcgggttaacaacggtaccggttagaaccggtacgtaccgttagggaacccggtacgaccggtacggtttacgtaaacgtttacgttaagggtcgggttaaaggggagtaaccgggggtaggaaccggtttaagggttaaaccgggtaagggtttaacgggtttcgggggaaaccggggtaccggtaaacggggg

SEQ ID NO: 267682 - DNA, 744 bp, Homo sapiens
  misc_feature: GYAE6OF01CQCWF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtacctgtggtgagggtgcgagtcgtgggtggagttcggtgggggagcgttggtcaggccggtcgggggtcccgagtctctccgtgtgcacgtcctcgtggtacttcctaccttactagttattttagcgtctagtcgacgtcgtccgggtaccgccgaggtccgtaccggaaaggggaacggtacgtaggtaaattgtcgtaccgtagtaaggttaagtaagaaagttaagtacgaaacgtaaataacgtaattaagttattaagtacgaaactaacttcggtaggtaaggtaacgaactacgacttaacccgacttaagcccgtaacgaacggttaccctaaacgtttaaccgaaacggtaacctacggttacctttgttaaaccttaccgtaagtaaccggttacggaccgtacgggtaccctaagggaaggtcgtacggaaacggcgtaacggtcggtaatagtttaagtcgttagcgggttaaggggagaacgggtagggtacggtaaggttaggtaacgggttagggtaggggacgggtacggaccgggtacccggg

SEQ ID NO: 267683 - DNA, 815 bp, Homo sapiens
  misc_feature: GYAE6OF01BLR43.28.57.F02.1.454.CMB.1.raw
  modified_base (243)..(243): a, c, t, g, unknown or other
  misc_feature (243)..(243): n is a, c, g, or t
  modified_base (313)..(313): a, c, t, g, unknown or other
  misc_feature (313)..(313): n is a, c, g, or t
  modified_base (462)..(462): a, c, t, g, unknown or other
  misc_feature (462)..(462): n is a, c, g, or t
  modified_base (541)..(541): a, c, t, g, unknown or other
  misc_feature (541)..(541): n is a, c, g, or t
tcagagtacgctatcacgaccggtgctcgatttagctcgatatagttgggtctgggagaggacgcccccgccctgggtttcccaggtgttctctatttggtgatcagcactgcacacagaagagtcatgacggtgtttgggctggagtcgttgggttttccttggttgtacttaagtttttaaagggtcgtaccgtagtgtggaggtcgacgaggtcgtgggtggtacggtcgggtagggggngtcgttcggtccgacggtccggtcgggggtcctgacgtcttcctcgtgtcgctcgtctgtgtacttaccnccttagtagttattgtccgtatacgtcgccgtcggtcggtcccgaccgccggtaccgtacgggacgggtaaaggtaccgtaaggtacgttagtcgtacgtacgtaagtacgtagaaaggtactaggactaaactatagtaatctaaagntaacttacgtgtacggaacggtacgcgtaatacgtaccacggaacttccgaacggtacgtaacttaaccgaaccggaanaaccgttcttccggttaaactagttacccgttaaggacggtaccgacggtaaccgttacggtacggaacggttaccgtacggaacgggaacccgggtacggtttaaccccgtaaggttaacgttaacccgttttaaaggtcgggggtttaaacggtaaaggggggttaccggaaagggggttaacccggggtaaacggttaccggggttaaaagggtttccccggggtttaaaggggtccggggttaaaccccggggaacgggttaccccgggg

SEQ ID NO: 267684 - DNA, 847 bp, Homo sapiens
  misc_feature: GYAE6OF01C9SLY.28.57.F02.1.454.CMB.1.raw
  modified_base (179)..(179): a, c, t, g, unknown or other
  misc_feature (179)..(179): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttaatttttaaaggngtccagtgtgaggtgcagtcgtggtggaggtcggtgggggagtcgttggtccgaggcccggtcggggggtccctggacgtaccttcgtccgtggtcgcgacgccttcgtggtacttcctaacctttacgtaagtttactttaacgttcggtaccttagtcgtaccgtaccggttcggggtcccgaccgtacggtccgtacccgggaaagggggaacgggtaacgtagggtaaacttagttcggttaccgtaacggtaaggttaaattaaaggtaaaaggtaacgtcgtaaaacgtaaaataaacctaattaatttaaatttaagtacgtaaaccgtaaacgttcgtaaggtagggtaaacggtactaaggttaaccttaacccgacccttaagttacccgtaacccgggtaaacggtaaacctaaaccgggttaacccaaaacggtaacccgtaacgttacgttaacgttacctttacgtaaacgtaaggttcgggaacctaacgtccgtaaggtacgtacgtacggaacggtaaccggtacggtaaccgggtcttaaacggttagtttaacgtacgggtaggggtaaggtaaggggaaggttaaacggggtagttaacggttacggggtaaggggtttacgggtcggggacgggccggtaaccgggg

SEQ ID NO: 267685 - DNA, 666 bp, Homo sapiens
  misc_feature: GYAE6OF01B7C01.28.57.F02.1.454.CMB.1.raw
  modified_base (173)..(173): a, c, t, g, unknown or other
  misc_feature (173)..(173): n is a, c, g, or t
  modified_base (210)..(210): a, c, t, g, unknown or other
  misc_feature (210)..(210): n is a, c, g, or t
  modified_base (484)..(484): a, c, t, g, unknown or other
  misc_feature (484)..(484): n is a, c, g, or t
  modified_base (582)..(582): a, c, t, g, unknown or other
  misc_feature (582)..(582): n is a, c, g, or t
  modified_base (596)..(596): a, c, t, g, unknown or other
  misc_feature (596)..(596): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagttttgggctgagcgtggttttcctgtgctattttaaagngtccagtgtgaggtgcagctggtggagtcgtgggggngtcgttcggtccagtccggtgggggtccctgacgactcgtcctgtcgcacgtcctcgtggtacttccgacctttcgaagtttaactttagtcgtcttaacgtcgtccctacgttccggggtccccgaccgacgggtccgtaccggaagggggtaacgggacctagggtaaacttagtcggttacctacgtaaggttaattaacggtaaagttagtacgtaacgtaaaataactaagttataacttagacgtaactaaactgtacgaggaacggnagtactaccactactcaccggaggtaactacgtaacgaacgaacgtccgtacttacgtagttaccctaagtaaggtcggaccaggtctaggaagtcgngagacgacgacgtntgtagtagttgagggtggaacggaggacggtacgtaggtacggtaggtagggttcggtgggcggtacggg

SEQ ID NO: 267686 - DNA, 1110 bp, Homo sapiens
  misc_feature: GYAE6OF01D64NB.28.57.F02.1.454.CMB.1.raw
  modified_base (187)..(187): a, c, t, g, unknown or other
  misc_feature (187)..(187): n is a, c, g, or t
tcagagtacgctatcacgaccggtgctcgatttagctcgatatagttgggtctgggagaggacgcccccgccctgggtttcccaggtgttctctatttggtgatcagcactgcacacagaagagtcatgacggtagtttgggctgagtcttgggttttccttgttgtactttaagtttttaaaggtntaccgtaggtggttaggacgggttgcgaggtcgttggggtaggtacggttccgggtggggggacgttcggtttcgggtcccgtacggtccggggttcgggggttccctggtacgtaccttcctccgtggtcgaccgtacgtccgttacgttacggtactttacccgtaaccgttttgtaagttttaacttttacgtcgtacttaacgtcgtaccggttaccgggttccgggggttacccccgacggtaacccggggtcccggttaaaacccgggggtaaagggggggtaaccgggttaaccgtttaagggttaaacgtttacggtttacgggttaaccgttaacgggttaaggtttttaaaggttaaaacggttaaacggttaacggttaacggtaaaccttaaaaacttaaacgttatttaaacgttaacgttttaacgtaacgtaacccgttaaaggttcggttaacgggtaacgggtaaccggtaccttaacggtttaacccttaccccgtaaaccttaaccggttaccccgtaaaccggggtaaaccggtaaacctttaaaccgtaaccggtaaaacgtccgtaaccgttacgtttacgtttaaacccgttaacgttaaaccgggtaacggtaccgggtaaccacggtttaacccggtaagggtaacccggtacgggttaacccggtaacgggtaacccgggtaaccgtttaccgggttaaacggtttaaccggtttacggttaacggttttaaccgggggttaacggggtaagggggttaacggggttaaacggggaacccggggttttaaacggggtttaaacgggttaaccggggggggtttttaaaacccgggggtggggggtttttaaacccgggggtacccggggggtaaaccgggtttaaaccccccggggg

SEQ ID NO: 267687 - DNA, 925 bp, Homo sapiens
  misc_feature: GYAE6OF01APS0A.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgacttaatttttaaaggtgtccagtgtgaggtgcagcgtggtggagtcggtggggggagtcgttgggtcccgacggtcccggttcgggggggtccctggacgtaccttccttcccgtggtgaccgtacggtccctacgtggtactttccgtaccctttacgtagtttaatttagtcgtacttagtcgtaccgtaccggttccgggtccccgccggtacggcccgttaccgggaacggggtaacggggtacgtagggtaacttaggttcgttaccgtaggtaggttaagttaaaggtaagttaagtagtaacgtaaataaacgtaattaacttaagttactagtaacctaaacgttcgtaggtaaggaacgggtacaacgttaccgtaccaaacgttctacccgtaacggtaacggtaaaccttaaccgtaaccggtaaacgtaacccgtaccgttacgttaacggtttaaacccttccggttaaaacgtaacgggttaccgggtactaacccggggttaccccgtaagggaaacgggtaccggtacggttaaacggggtaaccccggaaacgggttaccgtccgtttaaaggttttaaacgttaacccgtttaccgggggttagggggttaaggggaaaccggggtaaggggtaccggggtttaaaaccgggtttaaacggggtttaacggggtaacgggggtttttacccgggggggttaaggggggttccccggggaaacccggggggttaaacgggggg

SEQ ID NO: 267688 - DNA, 904 bp, Homo sapiens
  misc_feature: GYAE6OF01A89Z2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtacgtttgggctggagtcgttgggttttccttgttagtccttagtttttaaaggtcgtccagtgtgaggtgcgaggcgtggtgggacgttccggttaggggggaggttcgttgggtacccgaggtcccggttagggggggtccccctagggacgtacccgttccgttcccgttggtcgtccgacgtcccgttacgtaggtactttaccacccgtttacgtaacggtttaacgttttacgtcggtaccttaagtcgtaccgtacggttccgggtccccgaccggaacgggtcccgttaccgggaacggggaaacgggtacgtacgggtaaattaccgttcggttaccgtacgtaacgggtttaagttaaacggtaaaggttacgtacggtaacgtaaaacgtaaactaacgttagtttaacttacgtaacggtaaccctaacttacgttaggaacgggtaaaccggtacaacgttaccgtaccctaacctacgttacccgtaaccgggaacgggttaacctaaaacgtttacccgaaaaggtacccgtacggttacccttagttaaacctttccgttaaccgtaaaggcgggtacctaccggtaccggttacgggacgtaccggtacggttaccgggaacgtaccggttccggtacgttaacgtaccgttaaacggttcggtccggggttaaggaacgggtaacggtacggtaaggttacggttaacgggtaacgggttgggtttaaccggggccgggtaaacccggtacgggg

SEQ ID NO: 267689 - DNA, 863 bp, Homo sapiens
  misc_feature: GYAE6OF01AY0IK.28.57.F02.1.454.CMB.1.raw
  modified_base (181)..(181): a, c, t, g, unknown or other
  misc_feature (181)..(181): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttaagtttttaaaggngtccagttgtgaggtgcagctggtggtagtcggtgggggaggtcgttcggtcccacggcccggttcgggggggtcccctggtacgtaccttccgttccgttgtcggcctacgtcccttcgttacggactttccgtacctttcgtagttacttttaagcgtacctattcggacctacgtccgggtcccgaccgtacggccgttaccgggaagggggaacgggtactaggggtaacttagttacgttcccgagttaaggttaacgttaaggaaacgttagtacggtaacgtaaaacgttaaactaatttaattactttaaatccggaactaaaaccgtttgtacgggtttaagggaaaccgggtcgaaacggttaactttaccaacccttaacttccggtaccgtaaacggtaacgttaaacctacccgtaaagaacctaacggtacttagttacgttacctaaacgtaaacggtcgggtacagtaacccgttgggaacggttacgccggttacggggaagtaacccggtacggttacccgttaaggttaaccgtttacgtttaaaccggggtgggtaaagggggtaacggaacggggttaaacgggtcggggttaaaacggttaccgggtaaacgggtttaggggggtttacgggggaacgggggttcccgggtaaaccgggg

SEQ ID NO: 267690 - DNA, 675 bp, Homo sapiens
  misc_feature: GYAE6OF01B3908.28.57.F02.1.454.CMB.1.raw
  modified_base (307)..(307): a, c, t, g, unknown or other
  misc_feature (307)..(307): n is a, c, g, or t
  modified_base (388)..(388): a, c, t, g, unknown or other
  misc_feature (388)..(388): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcacgcctctggtattccaccttcagttatttatcgctatgcacgtgggtcccnccgaggcctccgaggggaagggctaggaatagtgtctacgaggttaattagaaagtagtgacgtaaataacgatatattancgtaactaaactctaggtacggaacggcaagtacttacaacctagtccgtacggaacgtaactaacgtaccgaagaccgacgtactacgttactaccttaacgaaggtacgggactaccgtaccgtaaggacgtaacggcgttaaggaaccggtacgacggtacgttaagtacgtttaacggttaccggtaggggtagggtaacggggaaggttacgggtaaacggttaaggttaacggggtaaacgggttaggggttcgggggtacggggtaaccggtaccggggg

SEQ ID NO: 267691 - DNA, 664 bp, Homo sapiens
  misc_feature: GYAE6OF01ALLA2.28.57.F02.1.454.CMB.1.raw
  modified_base (296)..(296): a, c, t, g, unknown or other
  misc_feature (296)..(296): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (425)..(425): a, c, t, g, unknown or other
  misc_feature (425)..(425): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgttgaggtgacagctgggtggagtcgtggggggaggcttggccgaggccgtggggggtccctgagactcctccgtgtgcacgtcctacgtggacttcgaccttcgattatttangctatgcacgtggtcccaccnggtccgtccgaagggaaggactacgggaatgtagtctacgtaggttattaagaagtaancgtaacgtaataaacatactaattagactacaatcgtagtagaacggtnaacgtacttaccaactagtacctacggaggaaccttaagtaacccaagtaaaccgacgttaccgtaacgttactacgtttaaccgaatacgggactacggtacccgttaggacgtacgtacgaaggtaaggacccgacgttacctagttaccgaagttacggaggttgggaagggtacgaacgggaggtaaacgtttacgggaacgttaggggttacgggtcggggtaacgaaccgggg

SEQ ID NO: 267692 - DNA, 818 bp, Homo sapiens
  misc_feature: GYAE6OF01ACCP1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttatttttaaaggtgtccagttggtgaggtgcagcgtggtggtagtcgtggggggaggcttgggtccaggtcccggttcgggggggtcccctggacgtacctccttccgtggtgcgacgtcctcgtgtacttcctaccttactagttattttatgtacttatcgaccgtacggttccgggtacccgccgacggtccgtacccggaagggggtaacggggtacgtaagggtaattacgttggtaccgtacggtaaggttaagttaaacggaaggttaatacggaacgtaaagtaactaattaattaagttatagaacctaaacttcgtagtaggaacggtactactacgttccactcgtcctacccggaagtacctaaccgtacaaagacccgtacgtaacttcgttatacccgtttaagaacggttacggacccaacggttccggtaaaggaggtaacccggtggttaacgggacccggtaacgggtacccggttattaaacgggtttaacgtttaaacgggttccggggtttacgggggtaagggggaacgggtaaccggggtaagggttaaccgggtttaaaggttaccggggttaaaggggggtttacgggggtaccggggttcggggggaaacgggttaacccccggggg

SEQ ID NO: 267693 - DNA, 865 bp, Homo sapiens
  misc_feature: GYAE6OF01DM8SD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttagtttttaaaggtgtccagtgtgaggtgcagtcgtgggtggtacgtcggtgggggacggtcttcgggtcccaggtccgggttcggggggtccctggacgtaccttccgttccgtggtcgccgtacgccttcgtaggtacttccgtaacctttcgtaacgtttaatttagtacgtcttacgtacgtacgtaccggttccgggttcccgaccgacggtaccgtaccggggaaagggggtaaccgggtacgtaggtaaacgttagttacgttacgttaacggttaggttaaagttaaggtaaagttaaacgtcgtaaaaccgtaaattaaactaatttaacgtttaattaacgttacgaaccttaaacgttcgttaacggaagggtaaacgtacgtaagtaccttaacccgacctacggttaccctaaccgggtaaacgtaccttaaaccgtaacggaaacccacgtacgttacgtacttaacgtacctttaacgacggtccgtaacgacgtacggtaaccgtagggtccggtaacgttacgggaaccgtaccggtcgttaagttcgttaaacgttaaggttacgggttcggggaacggggtaagggtaccgggaagggtttaacgggtaacggtttaacgggggttaaacgggttcggggggtttaacgggaacccggggtccgttaaacccgggggg

SEQ ID NO: 267694 - DNA, 932 bp, Homo sapiens
  misc_feature: GYAE6OF01CCBME.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgacacacagaagagtcatgacggtagtttgggctgagtcgtttgggtttttccttgtttaggtacttttaagttttttaaaggtcgttaccgtaggttggtaggtagggttgacgtagcgttgggtaggtaggttcgggtggggggtagttccggttcgggtacccgtacgggtccggggttccggggggttccctaggtaacgtcccttccgttccgttggttcgccgtcgttcccgttcgttacggttacctttccctaacctttacgtaacgttttatttacgttcgtacttacggttcgaccgttccggttcccgggtcccgaccggtacggtacccggtaccggggaaaaggggtaacggggtaccgttaaggttaagttacgttacggttaccgttaacggttaaggtttaaacgttaaagggtaaacgttaacggttacgtaaacgttaaaacgttaaacgttaaatttaatttaaacgtttacgtaacgtaacctttaaaacgttcgggttaaggtaaacgggtacggtaacgttaacggtaaccttaccctaaaccgtacgtttacccgtaccgggtaaacggtaaacctaacgtaaacccgaaagtaaccgtaccgttatacgttactacgttaaagacggtacgacgtacgtcgagtagggcgacggtacggacgtacgtaggttacctagttacgttaacggttcgggtagggttaggggaaacggtcgggaacggggttaacggttaacgggttacgggtttaacccgggttagggggtttaccgggtacggggtaccgggtaaccggg

SEQ ID NO: 267695 - DNA, 681 bp, Homo sapiens
  misc_feature: GYAE6OF01B6UTB.28.57.F02.1.454.CMB.1.raw
  modified_base (526)..(526): a, c, t, g, unknown or other
  misc_feature (526)..(526): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggtttccttgttgcttattttaaaggtgtccagtgtgaggtgcagcgtgggtggagtcgtggggggacgcgttgggtccgaggccggtggggggtccctgacggtctcctcctgtgcagcctcgtggtacttcacctttcgagttatttatgctatgctacgtcgggtcccgaccgaggccgtaccggaagggaagggtacgtagggtaaacttcgtaggtaccgtacgtaaggttaagtttaaaggaaagttaagtacgaacgtaaaataaactaattaataacgttaatagtaaccgtaaacttcgtaggtaaggaaagggtaccagttactacgaaacctctaccgtacgaacggaactaaactaccaaagtaaccncggtataccttattaccgttaagaaagtcgggacactccgaaggacgtaggtacgaggaacggtaccaggtacgtagttacgtaattcggtagggtaggaggtaggacggtaagtaaggttacgggaggttaaggggtgacggggcgtaacgggg

SEQ ID NO: 267696 - DNA, 897 bp, Homo sapiens
  misc_feature: GYAE6OF01AUF29.28.57.F02.1.454.CMB.1.raw
  modified_base (426)..(426): a, c, t, g, unknown or other
  misc_feature (426)..(426): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgaggagtttgggctgagtcgttgggttttccttgttgtcttagtttttaaaggtgtccaggtgtgaggtgcagcgtgggtggagttcggtgggggagtcgttggtccgagtccggtcggggggtccctggacgaccttccgtccgtgtcgcacgtccttgtggtacttcctaccgtttcgtaagtttatttagtcgtctagtcggtcctacggttcgggtcccgaccgaggtccctaccggaaggggtaacggtctaggaattagtcgtccgttagtaacgtttaattaaggaaggttanacggtaacgtaaacttaactaagttatttaaagttgtagtaacctaaacttcgtaggtaacggtaacggataacggttacctttaccgaaccgttacttcccgtaacggaaaggtaacccttaaacgttaacccgaaaagttaaccgacgtttccgttagtttaaacttaccgttaaacggtaaggttcggaaccgccggttaaacccgtggtaaaaccgtggttaacccgggttaagacccggggtaaacgttccccggtaacgtttacggtttaaaacgttttaccggtttaaacggggttcggggggaaaaggggttaaaccggggtaaaacggggggaaacggggtttttaaaccccgggtttaaacgggggggtttttaaaccggggtaaacgggggtttttttaccgggggggggaaggggggtttaacccccggggggttaaccggggtaaaacccgggggggg

SEQ ID NO: 267697 - DNA, 801 bp, Homo sapiens
  misc_feature: GYAE6OF01BLY24.28.57.F02.1.454.CMB.1.raw
  modified_base (113)..(113): a, c, t, g, unknown or other
  misc_feature (113)..(113): n is a, c, g, or t
  modified_base (177)..(177): a, c, t, g, unknown or other
  misc_feature (177)..(177): n is a, c, g, or t
tcagagtacgctatcacgaccggtgctcgatttagctcgatatagttgggtctgggagaggagcccccgcctgggtttcccaggtgttctcatttggtgatcgagcactgcanacagaagagtcatgacggtagtttgggctgagcgttgggttttcctgttgcttagttttaaggngtccagtgtgaggtgcagctggtcggagtcggagggggcgtcgtcggtccgagtccggtcgggggtccctggacgtccttcgtccgtggtcgcgacgtcccttgtaggtacttccaacctttgaagttaacgtttgacgtctaacgtcgacgtacggttccggacccgtacgacggtaccgtaacgggaacggggaacggtcgtaaggtactaacgttccgtcgtaacggtagttaaacttaaggtaaacgtacgtacggtaacttaaaacttaacggtaaacttagtttaacgttaacgtacgtaaccgttaaacgttccgggtacggttaaagggaccgggttaactaacgttaccgttaaccaaccccgttaggtttaccccaaacgggttaacgaaactttaaccgttaaacgaacgtaacgcccgtttaacgtagtttacccaacgtaggaaggtaccgcgttaaccaggttaggaccctagggacccttaagggacctacgtacggtagttaatttaccggaacgtttgggaaacggagggtaaccggtaaagtccgggaacgtttaacgggtcggtaaggggttcccgggttggggaacccggtcggtaaaccgggg

SEQ ID NO: 267698 - DNA, 772 bp, Homo sapiens
  misc_feature: GYAE6OF01BAZ19.28.57.F02.1.454.CMB.1.raw
  modified_base (338)..(338): a, c, t, g, unknown or other
  misc_feature (338)..(338): n is a, c, g, or t
tcagagtacgctatcacgaccggtgctcgatttagctcgatatagttgggtctggggagaggagccccccgccctgggtttccccaggtgttctcatttggtgatcagcactgcacacagaagagtcatgacgggagtttgggctgagcgtggtttcgtgtagctagtttaagtgtcagtgtgagtgcagctggtggagtgtgggggagcgttgggtccaggccgtggggggtccctggagactcgtcctgtacggccaggtcctcgtaggtacttcctaaccgttcaaggttaacttttaagtcgtactagtagtaccgtaacgttcgggggacccncgtaacggggtacccaccgggtaaggggtaaagggtaaccgttaggtaaacgtttagtacgttacggttaaccggttaaaggtaaccgtttaaaggaaaacggtttaagtaacggaaccgtaaaaagttaaaacgaattaaaaggtttaaccttttaaggaaccggtaaccttaaaaacggttcctaaaggggttaagaaacgggtacgaagttaaccgttcaaaccgtactaccgtaaaccggacggtaaactaaccgttaaacaacggtaaacacgtaacgtagttactacgtaactaggtaagctacgtaggtacgagacgtaggtaacgacgtaggccgaagttacagttaactacgtaggtagggaggacgggtacgaaggttaaggttacggtaaacggtagggttacgggtagggtccggaaacggg

SEQ ID NO: 267699 - DNA, 827 bp, Homo sapiens
  misc_feature: GYAE6OF01CQ6ZQ.28.57.F02.1.454.CMB.1.raw
  modified_base (716)..(716): a, c, t, g, unknown or other
  misc_feature (716)..(716): n is a, c, g, or t
tcagagtacgctatcacgaccggtgctcgatttagctcgatatagttgggtctgggagaggagcccccgccctggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccagccgtgggggtcctgagtactctcctgtgcacgtcctcgtggtacttcctacctttctagttaacttttagtcgtacttagtcgtaccgtaccggttcggggtccccgaccggtaccggtccgttacccgggaaagggggtaacggggacccttaagggtaaactttacgttacggttacccgtaccgtaagggttaaacgtttaaaggtaaaacggtttaaagttacggaaaccgttaaaaacgttaaaccgtaatttaaagtttaaacgtttaacgtaacgtaaccctaaaaccgtttcgttaacggtaacgggtaaaacggggtaccgtaagtaacccgtttacccaacccgttaaccgttcccgtaaacccgaacgggtaacttaaaccgttaccgaaacgtaaccacgttcctaagttactaccttagaaacggtgggaacctcggtacctaggtaacgcgttacgacggaacggaccgtaccggtnttaacgtaacgttacgttaacggtgggtaacgggtaaggacgggttaacgtaacgggttaaagttgggtaaaccggttagggggtcgggtaaccgggggtacccgtagggg

SEQ ID NO: 267700 - DNA, 746 bp, Homo sapiens
  misc_feature: GYAE6OF01BA68X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccagccggtcggggggtccctggacgactctcctgtgcagcctgtggtacttccaccttactagttacttttagtgtcctagttcgaccgtacggttcggggtccccgccggacggtcccgtaccgggaagggggtaaacggggtaccttaggggaaaatttacggttcgttacccgttacggtaacgggtttaaagtttaaaaggaaaacggtttaaagttacggaacggttaaaactaaacttaaattaactttaatttaacgtagaacccttaaacgtcgttaggtaggaacgggtactagtactaccactactccgtacgaggaacctataaccaagacctacgtacttagtacttacgtacgaaacgtgggaccagtcccgtaggacgtacgtcgaaggtacgcgtaaccgggtcgtagttaacgtttagtacggttagggtaggggtaagagggtacggaacggttaggttaacgggtaaacggttggggtttacgggtccggggtcggtaaccgggg

SEQ ID NO: 267701 - DNA, 814 bp, Homo sapiens
  misc_feature: GYAE6OF01B3LHJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggagtcttggtccaggccgtcggggggtccctggagactctcctgtgcacgccttgtggacttccgtaccttctagtttatttagtgtcttatgacctacggttcggggtacccgccgtagggtccctacccgggaagggggtaacgggtacgtagggtaaattacggttcgttacctacgtaagggttaatttaaacggtaaagttagttacggaagtaaaacgttaactaagttaatttaaagttacgtacgtaacttaaacccgttgttggtaaacgggtaacggtacgaagttaccgttaacccgtaactaaccgttacccggtaaccggtaacggggtaaaccctaaaccggtttaacccgaaacgtaacccgttaacgtccgttaacggtttacctttaaccgttaacgtaaacgggttcggaacgtaccgtacggtacggtaaaggtcgtacggttaacggaccgggtaaccggtacggtacgtttaacgttagttaacggttcgggtagggtaggggacggtaagggtaagggtaacggttaaggttaccgggtaagggtttggggttacgggtaggggcccggtaaccggggg

SEQ ID NO: 267702 - DNA, 792 bp, Homo sapiens
  misc_feature: GYAE6OF01BFL98.28.57.F02.1.454.CMB.1.raw
  modified_base (714)..(714): a, c, t, g, unknown or other
  misc_feature (714)..(714): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaagtttttaaaggtgtccagtgtgaggtgcagtcgtggtggagtcgtggggagcgttggccagccggtgggggtccctgacgctccgtcgtgtcgcgacgtcctgtggtacttccctacctttacgtagtttatttagtcgtcttagtcgtccgtaccggttccgggtcccgccgtaacggtccgtaccgggaaggggtaacgggacgtagggtaaattgtcgtacgtacgtaaggttaagttaagtaagttaagtacgaacgtaaataaacgtacttaatttaagttagtacgtaacgtaaaccgtcgttagggtaacgaaacgggtacgtaactttaccgtaccccgtaacttaccgttccccgtaaaccgggtaaaccgggtaaaccttaaacccgttaaccgaaaaccgaaccgtacccgttagtttaaccgttaacgttaaccggtaacgtaagggttccgaccgttaaccgtacggttacggaaggtacgttaccggaggtaaccggacgtacggttctaagtttaccgtaggtttacgggnggtaagggacggtagggaccggtaagttaggttaacgggtagggttaggggttcgggaccggggtgtaaccccggggg

SEQ ID NO: 267703 - DNA, 785 bp, Homo sapiens
  misc_feature: GYAE6OF01DXP43.28.57.F02.1.454.CMB.1.raw
  modified_base (538)..(538): a, c, t, g, unknown or other
  misc_feature (538)..(538): n is a, c, g, or t
  modified_base (656)..(656): a, c, t, g, unknown or other
  misc_feature (656)..(656): n is a, c, g, or t
tcagagtacgctatcacgaccggtgctcgatttagctcgatatagttgggtctgggagaggacgcccccgcctgggtttcccaggtgttctcatttggtgatcagcactgcacacagaagagtcagtcggacggtaggtttgggcctggagtcgtttgggtttttccttggttcgtacgtttaagtttttaaacggtcgtacctaggttggtacggtaggttcgacgtagtcggttagggtgggtaccgttggggtaggggggtacgttccgttacgggtccgacgggttcccggggtcgggggttccctaggacgttaccttccgtccgttcggtacgaccgtaccgtccgtacgttacggttaccttacctacctttagttagtttaactttagctactacgcgtacgtccggtcggtacccgcgcggtccgtacgggagggaacggtgtagtactacgtcgtactagtacggttaagtaagattaacgacgtaacgtaaactagtattactatacgaactacgtaccgtgtaagnggtaactgacgttctacgacgtactacgtacgtaaacggtaactaccgaaacgtaacgtacccgtacggttactaacggttacttaacgtaagtacggtaccgacgacgttaccgganaacgggtctacgggaacgtacgtgtaacggttctagttcgttaacgtaggggtagggaacgagggtacggaggtaacgggttacggttagggacgggttaggggtcccgggtacgggacggttaacggg

SEQ ID NO: 267704 - DNA, 676 bp, Homo sapiens
  misc_feature: GYAE6OF01EVJ1C.28.57.F02.1.454.CMB.1.raw
  modified_base (341)..(341): a, c, t, g, unknown or other
  misc_feature (341)..(341): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatcgcacgtcgggtccgccaggcctccgaggggaagggactggaatatgtctnaggttataagaagtaatagacgtaaataacattaatattatacgactaaaacttcgttaggtaggaaacgggtcaacgtaatttacccaaacctactaccgtaccgtaacgggtaaactaacttaacccgaaagaaaccgcgtaccttacgtaacttccttaacgtaaacgttcgggaactacggacccgtaggaacgaagtcgtacggaacggaccgtacggcgttacgttaattaacgttaccgttgggtacggggaaggacgggtaaggtagggtaaacgttaggggtaaacggttagggggtttcggggtacggggtaccgggtaacgggg

SEQ ID NO: 267705 - DNA, 643 bp, Homo sapiens
  misc_feature: GYAE6OF01D15EX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcacgcctcgtggattccacctttcagttatttatgtctatgcacgtcggggtcccgccgaggcctaccggaaggggaacgggctaggaatgtgtctcgaggtatagaagtatgacgaatacatatatatgactaactctgtagaagggacagtacttaccacctattccgtaccgaagggtactaacttacccgaaagaaccacgtacttagtacttacttaacgaagtcgggacagtccgtagaggtacgtcgtaggaccggacgtacggtcttagtaacttaagttacggtacgggtaggggaaggacggggtaaacggtacgggttaaaggttaggggtaaacggtttagggggtttcggggtacggggaccgggtaacgggggg

SEQ ID NO: 267706 - DNA, 759 bp, Homo sapiens
  misc_feature: GYAE6OF01B65O8.28.57.F02.1.454.CMB.1.raw
  modified_base (180)..(180): a, c, t, g, unknown or other
  misc_feature (180)..(180): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagtcttgggttttccttgttgcttaatttttaaaggngtccagtgtgaggtgcagctggtggagtcgtgggggagtcgttggtccagccgtcggggggtccctgacgacctctcctggtcgcacgcctcgtggtacttccacctttcagtttatttatcgtctagtcgctacgttcgggtcccgccgacggtccgtaccggaaggggaacgggtactagggtaaattgttcgtcgttacgtaaggttaattaaggtaaagtaagtcgaacgtaaaattaactaattaattaatttaacgtacgaactaaacttcgtaggtaacggaaacgggtactagttaaccttccgaaccctagtcccgtaccggtaaagggtaaacccttaacttaacccgaaaggaaccctaccggtacgtttacgttaacttaccgttaaacgtaaaggttcgggactaaaccggtccggttaaggaacgtacggtacggtaacgggacggtaaccgtacggttacttaagttaaccttaggttacgtgggtagggaagggtacgtagggtaacggttaaggttacggggtaaacggtggggtttcggggacccggggtcggtaacgggg

SEQ ID NO: 267707 - DNA, 880 bp, Homo sapiens
  misc_feature: GYAE6OF01EHEXG.28.57.F02.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatggacggtagtttggggctgagtcgttgggtttttccttgttgtcttaagtttttaaaggtgtccagtgtgaggtncagctggtggagtcggtgggggngtcgttggtaccgaggtccgggttcggggggtccctaggacgtacctccgttcctggtcgccgtacgtccttcgtacggttacttcctacccgtttacgtaagttaattttatcgcttaacgtcgccgtacgttcggggtccccgaccgtacgggtaccgtaccgggaaacgggggtaacgggtaccgtagggtaaatcgttacggttacttacggtaaggttaaagttaaggtaaaagtaaagtacggtaaacgtaaaattaaactaatttaaactttatttaactacgtaaaccgtaaacgtttcgtaaggtaggaaacggggactaacgttaaccgtcccaaacgttacctacccgggtaaaccgtaaccgggtaaaactaacccgttaaaccaaacgggtaaacccgtacccgttattaaaccggtttacttaccgttaaaccggtaaacggttaccgggtacggtaaacccgtcggtaggaaccgggttaccgacgggttaaggaccccggtaagggtccgttacggttaattaaacgtttaacgtttacgggtgggtaacggggtaaaggtaaaggggttacggaaacggttaaggttaggggttaacgggttaggggttacgggtccggggtaaacgggtacccgggg

SEQ ID NO: 267708 - DNA, 999 bp, Homo sapiens
  misc_feature: GYAE6OF01CUY0J.28.57.F02.1.454.CMB.1.raw
  modified_base (290)..(290): a, c, t, g, unknown or other
  misc_feature (290)..(290): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttaattttttaaaggtcgtccagtgtggaggtgcagcgtgggtggagtcggtgggggacgtcgttcggtccgacggtcccggttacgggggggttccctaggacgtaccttccgtccgttggtcnccgacgtccgttcgtggtacttcctacctttacgtaagttttagtttagtcgtacttagtcgtacgtaccggttccgggtcccgacccggtacggtacccgttaccggggaagggggtaaaccggtacggttaagggtaaacttagttccggttaccgttaaacggtaggttaaagttaaagttaaaacggtaacgtacgggtaaacttaaaacgttaaacgttaattaacgtttaaagtttaacaacggttaaacctaaacccgttttaggttaacgggtaacggggttaacggaaccgttaaggttaaaccctttacccttaaaacccggtaccgttttaacccggaaccccgggtaaaaaggttaacccttaaaaacccggttaacccgaaaaccgttaaccgtaacccggtacgttaaacgttttaccttaaaccggtttaacggaaaaccgggtttcgggaaccgtaacggttacccgaagggttaacccggtaagtcccccgggttaaagggaacccggggttaccctaacgggggtttaaacttaaccgtttaaacggtttaaccggttaacgggggttaaggggaacggggttaacggggaaaggggttacccgggttaaaggtttaaacgggttaaacggggtaaacgggggttttccggggtaacgggggtcccggggtaaacgggtaaccccgggggg

SEQ ID NO: 267709 - DNA, 794 bp, Homo sapiens
  misc_feature: GYAE6OF01AQYLE.28.57.F02.1.454.CMB.1.raw
tcagagtacgctatcacgaccggtgctcgatttagctcgatatagttggggtctgggagaggacgccccccgccctggggtttcccaggtgttctctatttgggtgatcagcactgcacacagaagagtcatgaggagtttgggctgagcgttgggttttccttgttgtcttaagtttttaaaggtgtaccagtgtgaggtgcagctgggtggaggtcgtgggggagtcttggtccgaggccggtcggggggtccctaggacgacctctcctggtcgcacgtcctcgtcggattaccacctttcgtaacgttatttagtcgtacgtagtacgccggtacgtcggggtcccgaccgtacgggtcctaccggaaggggaacgggacgtagggtaatagtgtactacgtaaggttaataaggtaaacgttagtacgaacggtaaataaacgtaaattaactaattacgtacgtaacctaaaccgttacgttaggtacggaaacgggtaccaaggttacttaccgaaccttacttaccgtaacccggaacggtaaacccgttaacgttaacccaaacgggtaacccaaccggtttcttaaccgtacgttaacgttaaaccgaagttaccgggaactaacggtacgtaacggtaagaacggtacgtacgggaaccgacggtaccgtgttacgttaaacttacggttaacggtggggtagggaagggaacggtaacgggtaccggttaaggttaccggttagggttacggggttacggggacggggaccgggtaaccggg

SEQ ID NO: 267710 - DNA, 837 bp, Homo sapiens
  misc_feature: GYAE6OF01CG2N9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttgttgtcttagttttaaaggtgtccgagttgtgaggtgcagcgtggtggtagtcggtgggggacggtcgttggtccgaggtcccggtgggggtccctgacgtacttcctccgtgtcgcacgccgtcgtaggtacttcctacctttcgtaagtttatttagtcgtacttagtcggtaccgtacggtcgggttccccgaccggtacggtaccgtacccggaaagggggaacgggtaccgtagggtaactaggttaccggtcccgtaaggttaaggttaacgttaaaggtaaagttaacgtacgtaaacgtaaaacttaaacgtagtttaatttaacttacgtaaccgtaactaaaacccgttgtaacggtaacggtaaacgggtacctaaacggtaacttacccgtaacccgtaacgtaccggttaaccggaaacggttaaaccgttaaaccgttaaaccgtaaaacgtaaccgaacggttaccgttaacggtacttaaccgttaacgtaacggtaccggtacgaacggtaccgtaggaacgtacggtacgacgggtaacgacggtaccggttagttacgttacgtttacgtaacggttgggtagggaaggtacgggaacggtaggttaaggttaacggtaaagggtacgggtttggggaccggggacggttaaccgggg

SEQ ID NO: 267711 - DNA, 863 bp, Homo sapiens
  misc_feature: GYAE6OF01DVAWS.28.57.F02.1.454.CMB.1.raw
  modified_base (121)..(121): a, c, t, g, unknown or other
  misc_feature (121)..(121): n is a, c, g, or t
  modified_base (217)..(217): a, c, t, g, unknown or other
  misc_feature (217)..(217): n is a, c, g, or t
  modified_base (507)..(507): a, c, t, g, unknown or other
  misc_feature (507)..(507): n is a, c, g, or t
tcagagtacgctatcacgaccggtgctcgatttagctcgatatagttgggtctgggagaggagcccccgccctgggtttcccaggtgttctcatttggtgatcagcactgcacacagaagngtcatgacggagttgggctgagtctgggttttcctgttgcttaagttttaaggtcgtccaggtgtgaggtgcagtcgtggtggagtcggtaggggngtcgtcggtccagccggttcgggggtccctagacgtactcctccgtggtcgcgacgtccttgtaggtaccttaccgtacgtttcgaagtttactttaacgtgtacttacgtccgtacgtaccggttcgggtaccccgtaccggtcgggtaaccgttacccgggaaaggggtaacgggtaacgttacggtaaagttcgtacgttaccgtacgttaaggtaaacgttaaggtaataggttacgaagtaaactaacgtagttaactattaacgtgaacttagtacgtggtaanacggtactagtacttaccactacctacgtaccggaaacgtacgtaacttaacgaacctacgtactacgttagtacttaccgttaacaaacggtcgggtataaccggtccgttagaacgggtacgtacggtaaccgtacgggtaaccccgggtacgttaaccggttaacgtttaaaaccgggtttacccgttggggttttaaacggggtaaaccgggggttaacccggggttaaaaggggggtaaacgtttaaaccggggttaaacggggtttttaaccggggggtaaaaccgtttacggggggggtttaacgggttaacccgggggggtaacccggtttaaaaccccccggggggg

SEQ ID NO: 267712 - DNA, 744 bp, Homo sapiens
  misc_feature: GYAE6OF01AYNXH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttaagtttttaaaggtgtccagtgtgaggtgcaggctggtggagtcggtgggggagtcgttggtccaggccggtcggggggtcccctaggacgtaccttccgtccgtgtcgccacggtcctacgttggtactttacctacccgtttacgaacggtttattttaacgtgtaccttaagtcgaccgtaccggttcggggtcccaccggaccgggtacctaccgggaaagggggtaacgggtacgttaagggaaatttacgtcgttaccgtacggtaaggttaacttaaaggaaagttagtacgaacgtaaacttaactaagttaacttattaagtacgtaacctaaaccgttgtacggtaaaggaacgggtactaaggtaccttacctaccgtagttccctaacgggaacggtaacctaacgtacccgaaacgtaccacgtacgtagtttaactacgttaacgaagtcggacgactcgtaggagtacgcgtaggacggtacgacggtgttataatacgttaggtggtagggacggagtacggagttaggtggtaacggttacggtgggacgggcggtacggg

SEQ ID NO: 267713 - DNA, 788 bp, Homo sapiens
  misc_feature: GYAE6OF01EB2OY.28.57.F02.1.454.CMB.1.raw
  modified_base (178)..(178): a, c, t, g, unknown or other
  misc_feature (178)..(178): n is a, c, g, or t
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtctatttttaaaggngtccagtgtgaggtgcagctggtggagtcgtgggggagcttggtccagccgtgggggtccctgagactctctgngcagcctcgtggtattccgacctttcgtaagttattttacgtgcttagtcgacgacgtcggggtacccnccgacgggcctacccggaagggggaacgggtacctaagggtaattaacgttcggtaccttacggtaaggtttaaagttaaggtaaaagttaaacgttcggaaacgtaaaaagttaaaactaaattaaagtttaaatttaacgtaaggttaaaccctaaaaaccgttcgtaagggtaacggaaacggggtctaaaggttaaccttaccgaaccctacgtttaaccgtacccggtaaagggtaacctaaacttacccggaaaaccgaaccgtaccggtacttaacgtaacgtttacgttaacgaaacggtcgggacaacgtacccgtaggtaacgacggtaacgtacgggtaaccggacgaacggtagttaaccgttaaagttacttacgggtagtagggggactaagggaaccggtaggtaaacggttagggaaacggttaacggggttgggtcgggaccggtaaggg

SEQ ID NO: 267714 - DNA, 690 bp, Homo sapiens
  misc_feature: GYAE6OF01CGFNJ.28.57.F02.1.454.CMB.1.raw
  modified_base (455)..(455): a, c, t, g, unknown or other
  misc_feature (455)..(455): n is a, c, g, or t
  modified_base (528)..(528): a, c, t, g, unknown or other
  misc_feature (528)..(528): n is a, c, g, or t
  modified_base (674)..(674): a, c, t, g, unknown or other
  misc_feature (674)..(674): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacggtagtttgggctgagtcgttcgggttttcctttgttgtcttaagtttttaaaggtgtaccagtggtggagtgcagcgtgggtggagtggtgggggaggtcgttcggccaggtccgggttcggggggtccctaggaacgtaccttccgtacccgtgtcgacgacgtccttcgtaggtattccgtaccttcgaattattagtgactagtcgacgtacgtcgggtccaccgacggctacgaagggaacgactaggaatagtacgtctacgtaggtaattaggaaagtaagtggaactaaacttaaacaacttaagtttataccgtanaacgtaaatcgtagtaggaacggatagtactaacactagtaccgtagacccgaaatactaaccgaaagtaccncgtatacgtactacaacgtaagcggacaacggtcaaggagtaccgtacggagaaccgagtacgtacttagtaacgttaagttcgtaaaggggaggaaggtagaacggggtcttaaagggtttgggaaacggttggggttaccgggnggaacccgggtaccgg

SEQ ID NO: 267715 - DNA, 814 bp, Homo sapiens
  misc_feature: GYAE6OF01CXKJO.28.57.F02.1.454.CMB.1.raw
  modified_base (149)..(149): a, c, t, g, unknown or other
  misc_feature (149)..(149): n is a, c, g, or t
tcagagtacgctatcacgaccggtgctcgatttagctcgatatagttgggtctgggagaggacgccccccgccctgggtttccccaggtgttctcatttggtgatcagcactgccacacaagaagagtcatgacggtagtttgggctgngtcgttgggttttccttgttagtcgtttaagttttttaaaaggtcgttaccgaggttggtggtagggtcgacgaggtcgttggggtaggtaggttcgggtagggggagtccggttcggtccgaggtcccgggttcggggggtccctaggtacgtcctcctcgtgtcgccacgtctcggtgtacttacccttaccttgttaacgtttattatcgtactagtcgaccgtcggtacgggtcccaccggacgtcctaacgggagggaacgtagtaggtaatacgtcgttacgtacgtaagttaagttaaacgagtactaacggtaaactaaagtaaataattaataattaacgtaacgtaactaaacgttcgtaggtaaggacgtagacgttaacctaccacctaccgttacgaaccggaacgtaactaaaccgtaaccgataaaccgcttaacgtaagtaccttaacgtttacgaacggtcgacctaaccggtccgtaaggtacggtaccgtaacggccgggtaaaacggtcgtaccgttaaggttaaccgttacttaccgggttacggggttacggtaagggggaaacgtaacggggtacggttaacgggttagggtttaccggtaacggggtttgggggtaacggacgggggtacccggtacgggg

SEQ ID NO: 267716 - DNA, 808 bp, Homo sapiens
  misc_feature: GYAE6OF01EBMLB.28.57.F02.1.454.CMB.1.raw
tcagagtacgctatcacgaccggtgctcgatttagctcgatatagttgggtctgggagaggagccccccgcccctgggtttcccaggtgttctcatttggtgatcagcactgcacacagaagagtcatgacggagtttgggctggagtcttgggttttccttgttgtcttagtttttaaaggtgtccagtgtggaggtgcagtcgtgggtggtaggtcggtgggggaggtcgttgggtccgacggtcccgggtcggggggtcccctggacgtaccttccgtccttggtcgtcacgtcccgtcgtggttacttccgtaccctttactacgtttattttagtcgtaccttaagtcgtaccgtacggttccggggtccccggaccgaccggtcccgtacccgggaagggggtaagggtaccgtagggtaaatcgttagttaccgtaggtaaggtttaagtttaacggtaagtaagtacgaagtaaacttaaagtaatttaattaaattacgttacgtaacctaaacgtttctagggttacggaacggtactaaggttaccttacccgtaaccgtccttacccggtacggtaaacgttaaaccgttaaaccgttaccgaaaaccggtaacctacgtaacgtttagttaactaccgttaagtaacgtggcgtacgcggtaggagtaccggtacgtacggaaggtacccgtggttagtgttacgttaggttagggtacgggtaggggaggtagggtaaccgtagggtaacgggtttgggtaaaccgggttggggtcgggtagggtcggtacggg

SEQ ID NO: 267717 - DNA, 696 bp, Homo sapiens
  misc_feature: GYAE6OF01D41YK.28.57.F02.1.454.CMB.1.raw
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatagacggagtttgggctgagcttgggttttccttgttgtacttaatttttaaaggtgtccagtgtgaggtgcagcgtgggtggtagtcggtgggggaggtcgttacggtccaggtccggtgggggggtcccctggaacgaccgtcctccgtaggtcgacgacgtccctcggtaggtacttcccgtaaccctttgtaagttattttagcgtattaagtcgtacgtacggtcgggtcccgaccgaggtcctaccggagggtaggaactaggtaatagtcgtcgacgtaggtaagtaagaagtacgtcgaagaaactaanattatatanagaactaacgtgtagaggagacgatacttacaccatccgaacgagtataactacaanactcgtctagtactcaagaagcggacacgtcgaggaacacgtagtacccgggaaaggtatcgtaacgtttaagtccggttaaaggcggggtaagggaaggacgggtaaacggtacccgggttaaggtttaaacggggtaccggttttaacgggggtacggaccggggggtaccagggggtaacccccg

SEQ ID NO: 267718 - DNA, 874 bp, Homo sapiens
  misc_feature: GYAE6OF01BLF0V.28.57.F02.1.454.CMB.1.raw
tcagagtacgctatcacgaccggtgctcgatttagctcgatatagttgggtctgggagaggacgccccccgccctgggtttccccaggtgttctctatttggtgatcagcactgcacacgaagaagagtcagtggaacgggtggtttgggctggacggtcggttttcgggttttccgtttaggttggtacttttaaagtttttaaaagggtcgttcctaggttggtggtaggtgacgaggtcgttggggtggtagggtcgggtgggggtacgtcggttggccgtcgggtccggggttccgggggttaccctagggaccgtaccgttccttaccggtgtcggcctaccggttcccgtgtacggtacttacccgttaccctttgtaaacgtttaactttggtcgttactaacttcgcccggttacgggttccggtccccgtaccggacggttacccgaacggggtaaaacgggggaacggtaaccgttaggttaaacctgtttccgtaagtttaacggtaaggttaaagttaaggttaaacgttagaaaccgtaacgaaaattttaagaaatttatttaaacggtaacgtacgtaaacgtaccgtagggttagtaacgggaacgtagtaacgtactacgtaactacgtaccgtaggaacgtaacgtaacgtacctaacgaaccgttaacgtacgttacgttaacgtacgtaggtaacgcggtaacgtcggtaacgtcgaacggtactaaccgggcgtaaacggaccgttacgtagtaacgttaacggttacgttagggacggtaaggtacgggtaaggacccggtaaggtaggttacgggtagggttacgggtcgggtcgggtaccgggtaccggg

SEQ ID NO: 267719 - DNA, 805 bp, Homo sapiens
  misc_feature: GYAE6OF01CO1BX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaattttaaaggtgtccagtgtgaggtgcagcgtggtggagtcggtgggggaggtcgttggtccacggcccggttcggggggtccctggaactcttccgtccgtgtcgcgacgtcctacgtggtacttccgtacctttagtagtttatttagtgtccttagtcgctacggtcgggtccccgcgtaacggtccctacggaacgggggaaacggtaccgtaaggtaacgttacgtcgttaccgtacggtaaggttaagttaaaacggtagtaaagttacgaacgtaaactaaataattaaagttattaactacggtaacctaaacgttggtaagtaacggaaggtaccctaagtacttaaccaccttacgttaccccggaaccggaaggttaaacctaacttaaaccgaaacgtaaaccgtaccggtaccttaaggtttaacccttacgttaaacgttaaaaccgggcgggtaaccgttaccggaccgtagggtaacgacggtacggtaaggacggtaccgacgggttacgttagtaaaccgtttaagtacggtacgggtaagggaaggtacgggtaacgggtagttaaaggttacggtaaacgggttacggggttgggaccgggggtagtaccggggg

SEQ ID NO: 267720 - DNA, 757 bp, Homo sapiens
  misc_feature: GYAE6OF01CYFQT.28.57.F02.1.454.CMB.1.raw
  modified_base (122)..(122): a, c, t, g, unknown or other
  misc_feature (122)..(122): n is a, c, g, or t
  modified_base (279)..(279): a, c, t, g, unknown or other
  misc_feature (279)..(279): n is a, c, g, or t
  modified_base (597)..(597): a, c, t, g, unknown or other
  misc_feature (597)..(597): n is a, c, g, or t
tcagagtacgctatcacgaccggtgctcgatttagctcgatatagttgggtctgggagaggacgcccccgccctgggtttcccaggtgttctcatttggtgatcagcactgcacacagaagngtcatgacggtagtttgggctgagtcgttgggttttccttggtttcgtctttaacgttttttaaaggtcgtccgtagttgtggaggtgcgagccgtgggtgggtagtcgggtgggggacgtcgttcgggtccgacggtccggttcggggggttcccngacgtcctcgtccgtgtcgcacgtcctagtacgtacttccgtaaccgtttcgacgtttaagtttattcgtcgttaagtcgaccgtacgtccgggtacccgccgacggtccgacggaagggtaaccggtacgtaaggtaactacgtacgtacgtacggttaagtaaagttaaagaagttaagaccgtaagtaaactaacgtaattaattacgttaatacgtaactagttcgaagtaggaacggactaacgtcgtaccacgtactaccgaaccggtagtaacccaacgtaagaaccgtcactacgtcgtaacctgtaaanacggtcggtaccagacgtaggacgtacgcgttagaacgtaccgtagttacgtagtagttaacggtacggaggggttaacgaagggacggttaccgggaaagtttaaccggtagggggtttaaagtcggggttagggggaacccgtcggggtaaacccggg

SEQ ID NO: 267721 - DNA, 812 bp, Homo sapiens
  misc_feature: GYAE6OF01ATPTL.28.57.F02.1.454.CMB.1.raw
  modified_base (298)..(298): a, c, t, g, unknown or other
  misc_feature (298)..(298): n is a, c, g, or t
  modified_base (647)..(647): a, c, t, g, unknown or other
  misc_feature (647)..(647): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgtcttattttaaaggtgtccagtgtgaggtgcagcgtggtggagtcgtgggggagtcgttggtccaggtccggtcggggggtccctggacgaccttcgtccgtgtcgcgacgtcctcgtggtacttcctaccttntaagttatttatcgtcttagtcgccgtacgtccgggggtcccgaccggacggtccctaccggaaggggaacggtagtagggtaacttacgttcgtcgttacgtaaggttaagtaaggtaaacgtatacggaaacgtaaaataacgtaattaatttaattacgtacgtaactaaacgttacgttaggtaacgacgggtaacctaagggtaccttaccgaaccttacgttaccgtaccggaaacggtaaccttaaacctaaccggaaaagaccgtaccgtagttaactttcgtaacttaacggtaagtcgggaacctacgtaccggtaagacgggtccggttaaccggganaaccgggggtaacctacgggttaccttaaggttaacgttaaggttttaccggggaagggggtacgggaaagggtagggtaaacccgggggttttaaggaaccggggttaagggttaaacggggggtttggggtcgggggtaaacgggggtacccggtaagggggg

SEQ ID NO: 267722 - DNA, 739 bp, Homo sapiens
  misc_feature: GYAE6OF01ALWCP.28.57.F02.1.454.CMB.1.raw
  modified_base (327)..(327): a, c, t, g, unknown or other
  misc_feature (327)..(327): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtaggtttgggctgagtcgttgggtttttccttgttgcttaagtttttaaaggtgtccagtgtgaggtgcagcgtgggtggaggtcggtgggggagtcgttcgggtccacggtccgggtcgggggggtccctggacgtaccttcgtccgtgtcgccagtcctgtggtacttccacctttcgagttactttagtcgntactgacctacggtcgggtcccgaccagggtcctaccgggaaggggtaacggacgtagggtaaatagtcggttcctaggaaggtttaagttaaggaacgttagtacgtaccgtaaaataaactaattaattagttaagtctaactaacgttactagggtaaggaacggtactaacggtactttacccaaccgttactacgtaaccggtacggtaaactaaccgttaacaaacggtaaccaccggttacgttacgttaacctacttaacggtaacgtccgggaactacggtcctaaggagtacggtacgaggaaccggtactacggtatacgttagtacgtacggtggtagggacgtaggtagggtaagtacggtaagggtacggttagggtacggtggggtaccgtacgggg

SEQ ID NO: 267723 - DNA, 771 bp, Homo sapiens
  misc_feature: GYAE6OF01CULR4.28.57.F02.1.454.CMB.1.raw
  modified_base (200)..(200): a, c, t, g, unknown or other
  misc_feature (200)..(200): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgagtgcagctggnggagtcgtgggggagtcgttggtccaggccgtggggggtccctgagactctcctgtgcagcctcgtaggtacttccaacttcgtagttatttatgtacttatcgacgtcgttcgggcccgccgaggcctaccggaagggggaacggacgtaggtaaacttagttacgttaccttagtaaggttaagtttaaggaaagttaaagtcggtaaacgtaaacgttaaacgtaattaactttaaagtttaacgtacgtaaactaaaaccgtttcgtacggttaggaaacgggtactacgtaacttaccctaccgtaacgtcccgttaacccgaaacgggtaactaaaccgtttaaccgaacggttaaccaacgtaccgttcgtaacttacgttaaccgtaaagtcgggtactaacggccttacggacgtacgtacgtacggaccggacgtaccggtattacgtaaacgttacgttaacggtacgggtaagggaagggttacgggaaacggttaggaaacggttacgggtaaacggtttaggggttaagggttccgggggaacccgtaaccgggggg

SEQ ID NO: 267724 - DNA, 862 bp, Homo sapiens
  misc_feature: GYAE6OF01ALRQW.28.57.F02.1.454.CMB.1.raw
  modified_base (690)..(690): a, c, t, g, unknown or other
  misc_feature (690)..(690): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtccagtgtgaggtgcagcgtggtggagtcggtgggggaggtcgttacgggtccacggtcccggttcgggggggttcccctggacgtaccttccgtcccgttggtcgcacgtccgttcgtaggtactttcccgaaccctttcgtaagtttattttatgtccttaagtcgccgtaccggttcgggtaccccgaccgacggtcctaccggaaggggtaacggtacgtaggtaattacgttcgttacgtacggttaaggttaatttaaggtaaagttaagtacggtaaaccgtaaaacttaaacgtaatttaatttaagtttaagtaacgtaacccgttaaaacgttcggttaacggtaagggaaacgggtacgttaacgttaccgtacccaaccgttacgtacccgtaaccggtaaacggtaactaaaccgttaacccgaaaacgtaccgtacccgtagtttaacgttacttaccgttaaacgtaacggtcgggacctaacggtccttaaaggngtaaccggtacgtagggaaacccggtaccggacggttacgttaacgttaacgtttaaacgttcggggttagggaagggggttaacgggagggtaaccgggttaacgggttaaagggtttaccggggaaggggtttaggggttcccggggtgggggaacccggtaaccggggg

SEQ ID NO: 267725 - DNA, 787 bp, Homo sapiens
  misc_feature: GYAE6OF01DAWP0.28.57.F02.1.454.CMB.1.raw
tcagagtacgctatcacgaccggtgctcgatttagctcgatatagttgggtctgggagaggagccaccgccctgggtttcccaggtgttctcatttggtgatcagcactgcacacagaagagtcatggacggtgtttcgggctggacgtcgttcgggtttttccttgttacgtctttaagtttttaaacggtgtacctaaggtgtggaggtcgacgaggtcgtgggtaggtgttcgggtgggggcgtcgttggtaccgcggtccggttcggggggtccctggactccgtcgttccgtagtcgactcgtcctagtggtacttcctaccttgtagttatttagtgtctagtcgacgtacgtccggtccgacgacggtccgaccggaaggggtacgtacgtaggtaattacgtcgtacgtagtaaggttacgtaagtaagtacgtagtaacgtaactaacgttataagttacgtaagaccggtaactacgttacgtggtaaggaccgtagtaacgtcctaccgacgtacgttaccacggtaactaacgttaaacgtacgaaaccgtacgtccgtaacgtttactaccgttaacgtaaacgtcgggttaacgaccgtacgtaccggtaagcgttaacccggagtacggacggtacgtacggtacgtttaacgttaatccgggtttaggtaccgggtaaggggtaggtaaaacccgggtggttaaacggggttaacgggtttaaagggcccgggggtttaacggggttaacggggtcgggtaaaccccgggg

SEQ ID NO: 267726 - DNA, 796 bp, Homo sapiens
  misc_feature: GYAE6OF01C9220.28.57.F02.1.454.CMB.1.raw
  modified_base (544)..(544): a, c, t, g, unknown or other
  misc_feature (544)..(544): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacgggtagtttgggctgagtcgtttgggtttttccttgttgtacttttaagttttttaaagggtcgtccgtagttggtggaggttgcgaggtcgttggggtaggacggttcgggtggggggaggttcgttcgggtcccgacgggtccgggttcgggggggtcccctaggaccgtaccttccgttccgttggtcgcgaccgtccgttacgtaggtacctttacctaacctttcgtaaggttttatttacgtgtcttatcggctacggtccggtcccgccgacggtccgtacgggaaaggggtacggtacgtagtaattcgtcgtactacggtaagttagttaaagaagttagagtaaacctaaagtaactaagttaactagtttacacgtaactaacgttgtaggaacggtagtacnttaacctaccgaccttactaccgtaccgggtaaagtacgttaaacaaccgtaacgaccgtaccgtactttacgttaactttaccggtaacgaacggtcggaaccgtacgtacgtaggagcgttacgacggacggtaccgtagtcgttaagtaacgtttcggttacggtagggacgggtaaaggtacgggtacgggtaagttaacgggtacgggttacgggttggggttaccgggacgggtcgggtaacccgg

SEQ ID NO: 267727 - DNA, 883 bp, Homo sapiens
  misc_feature: GYAE6OF01DRXGM.28.57.F02.1.454.CMB.1.raw
tcagagtacgctatcacgaccggtgctcgatttagctcgatatagttgggtctgggagaggagccccccgcccgtgggtttcccaggtgttctctatttggtgatcagcactgcacacagaagagtcatggacgggtaggtttgggctggaggtcttgggtttttcctgttgtacttaaagttttaaacggtcgtacgtagtgtggaggttgacaggtgtggtggacgtgggtgggggtacggtcgttcgggtaccacgggtcccggggttccggggggtaccctaggtaacgtcccgtttctcccggtttgacgaccggtaccgtcgttaccgtacggttaaccttccgttaaacccgttcttaagtttaaacgtttctacggtacttaacgtccgtaccgtaacggggtccgggttaccccggccgggtaacgtacccggttaccgggaaaggggtaaacgggtacgtaacggttaattagtacgggtttcaacgggtaagttaaacgttaagtaaagtaacgtaacgttaaacgaaacttaacgtaaattaacgttaagtaactacggtaacaaacgtacggtaagtaacgaaggtacctaaacgtcgtaactaacccgtacgtaccgtaacggtaaacgaaccttaaacgtaaccgaaacggaaacgtaccgttaacggtaacgtttaccttaaccggttaaacgtaacgtaccgggtaacgtaaccggttaccggaaagtacccggaggttacgaaggtcgggtaaccgtacgttagtaacgttagtaacccgttaggtaccgggagtaaaccggtagggtacggtacggtaaaggtacgtacggggttagggacgggtacggtaaccggggtacggg

SEQ ID NO: 267728 - DNA, 656 bp, Homo sapiens
  misc_feature: GYAE6OF01EH4T3.28.57.F02.1.454.CMB.1.raw
  modified_base (194)..(194): a, c, t, g, unknown or other
  misc_feature (194)..(194): n is a, c, g, or t
  modified_base (240)..(240): a, c, t, g, unknown or other
  misc_feature (240)..(240): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (379)..(379): a, c, t, g, unknown or other
  misc_feature (379)..(379): n is a, c, g, or t
  modified_base (482)..(482): a, c, t, g, unknown or other
  misc_feature (482)..(482): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctggagcgtggttttctgttgcttagttttaaaggtgtcagtgtgaggtgcagngtggtggagtgtggggagtctggtccaggtccgtgggggtccctgngactctcctgtgcgagtcctctggtacttcacctttgattattttagtntctagttcgacgtaccgttgggtcccncgtacggccgtaccggaaggggaaggcctaggtaatgtcgtctagagttattaagtaacgtangtaacgtaataatataattatagtacaataacgtctaggtacggaaggtctacgacttacgaacctcttacgtacgaacggttactaacgtaacgaacgtaanaccggttatacgttacctataccgtaagtcggaacacggtccaggaacgttcgtaaaggcgtaacgaccgtagttacgttataaccgtttagtccgggttaaggtaggggaacgtaggggaccgtaaggtaacggttaacggtagggttacggtacgggagggtcgtaccgggg

SEQ ID NO: 267729 - DNA, 802 bp, Homo sapiens
  misc_feature: GYAE6OF01BICLD.28.57.F02.1.454.CMB.1.raw
  modified_base (231)..(231): a, c, t, g, unknown or other
  misc_feature (231)..(231): n is a, c, g, or t
  modified_base (785)..(785): a, c, t, g, unknown or other
  misc_feature (785)..(785): n is a, c, g, or t
  modified_base (799)..(799): a, c, t, g, unknown or other
  misc_feature (799)..(799): n is a, c, g, or t
tcagagtacgctatcacgaccggtgctcgatttagctcgatatagttgggtttgggggggtccctgagactctcctgtgcagcctctggattcaccttcagttatttatgctatgctacgtcgggtccgccacggctccgaaggggaagggactaggaatagtgtctacgtaggtattaagaagtagtgacgaataacatattattatgactaactctggtaggaacgggntaagtacttaccaacctattaccgtaccggaacgggtaacctaaccgttacccgaaacgaaaccgaccgtcttacgtattccttaacgtaaaggtcggaccgacggtccgtaggacgtacggtactacgggaacggaccgtcggtacgtagttattacgttcgtagggtacgggaggtaggtaggacggttaacgttagggtaacgggttggggttacgggtacgggtaccggacgggaccggtccggtaccggtccgtacccgttcccggtcctacggacccgtaccccgtacccgaccggtaaccggcccgttacggttccccggtttcccccgtccccgggttacccggccccgtacccgttaccgccggtccggtaaaccgggcctaccccgtaacccgggtacggaccggtaccgaccgtacccgggacggcccccgggtcggtaccgggtccgtaccggtccggttaacggtaaccggacgtttaccctacggtacctaggtacccgtcggtatcccgggtaaggccgggtacgcgtacggaccgtancggatagacgtcgntcg

SEQ ID NO: 267730 - DNA, 857 bp, Homo sapiens
  misc_feature: GYAE6OF01DZTQ1.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcagtgacgggtagtttgggctgagtcgtttcgggttttccttgttgtactttaagttttttaaaaggtcgtacctaggttggtggtaggtcgcaggtcgtgggtggaggttccgggtagggggaggtcgttcgggtccgaggtcccgggttacggggggtcccctaggacgtccttccgtccgtggtcgcgtacggtccttcgtaggtaccttcctaccgttagtaagtttagtttattcgtacgtagtcgtccgtaccggttcggtccgacccggacggtccgttaaccgggaaggggtaaccggtaggtaaggtaacgttacgttcgtaacgttacggttaagttaaggttaacgtaaaagtaagtacggtaaacaaacttaaagttaattaatttaattaagaacgttaactaaacgttaccgtagggttaacggaaagttacgtaaagtaccttaaccaccgtacgtaccgtaacggaacgaactaaacgtaaccgaaacgtaaccgtagtacttagttaacgtaccgttaacggtaagtcggaccgacgttacgacggaagtaccggtaggaccggtaacggacgtaacgggtcttaacggttaacgtaaggttacgggtaaggggtagggaaagggtaacggggtaaagggtacggttaaacgggttttaacgggaacggggtttaaagggggttccgggggtaaacgggcggggttaaacccgggg

SEQ ID NO: 267731 - DNA, 789 bp, Homo sapiens
  misc_feature: GYAE6OF01C4NF9.28.57.F02.1.454.CMB.1.raw
  modified_base (335)..(335): a, c, t, g, unknown or other
  misc_feature (335)..(335): n is a, c, g, or t
  modified_base (363)..(363): a, c, t, g, unknown or other
  misc_feature (363)..(363): n is a, c, g, or t
  modified_base (643)..(643): a, c, t, g, unknown or other
  misc_feature (643)..(643): n is a, c, g, or t
tcagagtacgctatcacgaccggtgctcgatttagctcgatatagttgggtctgggagaggacgccccccgcccgttggtttcccaggtgttctctagtttggtgatcagcactgcaacacaagaagagtcagtgacggtagtttgggctaggagtcgttcgggtttttccttgttcgtacgtttaaagtttttaaaggtcgtccgtaaggttgtagggtaggttcgaccgagtcggtgggttaggaggtttcggggagggggagttccggtttcgggcccagggtcccgggtcgggggtccctagacgtactcctcgtgaccgctcgcctggtntcttccactttagtattattcgtgactntcgacgtccgtcggtcccacggacgtcgaccggagggaacgagtagacttaggtgtcgagtaagtaataaggaacgtgaagaataaaacagttaaacttaagttataacgtaacgtaaaccgtaaagtttcgtaagggtaaaggaccgaagtccgtaacttacccgaacctacttacccggaacgaaagtaacctaaaccgtaacggaaaccaacccgtagtaacgttaccgttaacgttaacgtaaagttacggacccgtaagtaaccgtcgtaaacgngggaacgacgtaacggtaaccgacggtacgttactagttagttaacgttaggtaaccgggaggaacggtaaagggaccggttaaagggtaaacgggttaaggttaacggggttaggtaacggggttaccgggacgggttaaccggg

SEQ ID NO: 267732 - DNA, 927 bp, Homo sapiens
  misc_feature: GYAE6OF01BA2AM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggtggaggcttggtccagccgtggggggtccctgagactctcctgtgcacgcctctggattcaccttcagtatttatgctatcgctacgtcggggtcccgccgaggtcctaccgaagggggaacggggtaccgtagggtaaacttagtgggttaccttaccgtaagggtttaagtttaaggaaaggttaaagtcggaaaccgtaaaagtaaaactaagtttaacttaaagtttaactaggtaacctaaaaccgtttacgttagggttacgggaaacggggtaccaaggttaacctttacccaaacccttaagttaccccgtaccccggaaaacggggtaaacccttaaaacgtttaaccccggaaaaacgtaaacccgtaacccgggttaccgtttaaccggtttaacctttaccgttttaacccggtaaaaagggttccgggggaacctaaccgggtaccccgtttagggaacgggtaaccggttaacccggttaggggaaacccgggtaaaccgggtacccgggggttacgtttaaacgggttaaaccgttttaacggttttaacccgggttaggggggttaaaccggggggtaaaggggtaaacggggggtaaacccggggtaaaccgggggttaaaagggttttaaccggggggtaaaaccggggtttttaacggggggggttttagggggtaacccggggggggtaaaccccggggg

SEQ ID NO: 267733 - DNA, 744 bp, Homo sapiens
  misc_feature: GYAE6OF01AOAHN.28.57.F02.1.454.CMB.1.raw
  modified_base (178)..(178): a, c, t, g, unknown or other
  misc_feature (178)..(178): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttatttttaaggngtccagtgtgaggtgcagctggtggagtcgtgggggagcgttggtccgaggtcccggtggggggtcccctggacgtacctcctccgtgtcgcacgtcctcgtggtacttccgtaccttactagtttatttagtcgtcttagtcgcgtaccgtcgggtcccgccgtacggcctaccggaaggggaacggtacgtaggtaactgtcggtacgtacgtaaggttaattaaggtaagtaagtacgtaactaaagtaactaattaattaatttaacgtacgtaacctaacttcggttaggaacggtaacggtacacggttacttaccgtaaccgtacgtacccgtaccggtaaacggtaactaaccttaaccgaaacgaccgtacgtacgttacgttacttaccgttaacgaacgtcggaactacggtacgtaggtactacggtcgtaagccggacgtacggtcttaagtacgtagttcggtagggtacggggagtaggggacgttaaacgggtaacgtttacggggtaacgggtttaaggggtccggggtacggggtcccgggtaacggg

SEQ ID NO: 267734 - DNA, 980 bp, Homo sapiens
  misc_feature: GYAE6OF01BBDY2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatggacggtagtttgggctggacgtcgtttgggtttttccttggttgtactttaaagttttttaaaggtcgtccgtaggttggtaggaggtcgacaggtcgttggggtgggtaggttcgggtaggggggtacggtttcggttaccggccggtaccgggttccggggggttcccggggtccgtaggtacctccgttccgtcgtgcgaccgtccgtccgttggttacgttacctacccttaccgttagttaagttttattcgtctacgttacggtccgtaccggttcgggtccccggtcccggacggtaccggtacccggtaacgggggaaacggggtaacggttaggtaagttacgttacgttcgtaacggttaaggtttaagttaaaaggttaaacggaaagttacggttaaacgtaaaactaaaacttaagttaaatttaagtttaacgttaacgtaaccgtaaaacgtttacgtaggttaagggaaaccggggtaacgtaacgtaactttccccaaccgtaacccgttacccgtaaccggtaaaccggggtaaaacccgtttaaaacctaaccggtaaaaaccgggaaccccttagggtacccgttttaacgtttaaacgtaccgtttaaacgttaaacggacccggggtaccgtaaccgtaccggttaggaacgggtaacggtccggtaagggtaaacccgggaaccggtacggttaacgttaggtttaaacgtagtttaacggtaggggcgggtaagggacggaaggggtaccggttaaaggggtttacgggttaaacgggggttcgggggtttaggggaaacccgggggtcgggaacccggggttaccggg

SEQ ID NO: 267735 - DNA, 737 bp, Homo sapiens
  misc_feature: GYAE6OF01DAX6J.28.57.F02.1.454.CMB.1.raw
  modified_base (263)..(263): a, c, t, g, unknown or other
  misc_feature (263)..(263): n is a, c, g, or t
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttcttgttgcttattttaaaggtgtcagtgtgaggtgcagcgtggtggagtcgtgggggagctggtcgaggccgtggggggtccctggagactctccgtgtgcagcctcgnggtacttcaccttcaagttactttatcggcttancgcacgtcgggtcccnccgaggccgtaccggaaggggaacggacgtaggaattagtagttcctagaagggttaattaaggtaaagtaaatcggaccgtaaaagtaaaactagttaattaatttaagacgtaactaaacgttcgtagtaaggaaacgggactagtaacgttacccaactaactccgtaccgtaaacgggaacttaaactaaccgaaacgaaacgtaccggtacttaacgtaacgtttaccgttaaacgaacggttagggtaccaacggttaccgtaacggtaaggtacgaccggttaaggaaccgggtaccgtaacggtaccgttaggttaaactacggtttacgtagggtaacgggaaggtaacgggaacggtagggtaaagttacgggtaaacggttggggttacgggtcggggtaacgtaaccggggg

SEQ ID NO: 267736 - DNA, 965 bp, Homo sapiens
  misc_feature: GYAE6OF01EHQ2S.28.57.F02.1.454.CMB.1.raw
  modified_base (126)..(126): a, c, t, g, unknown or other
  misc_feature (126)..(126): n is a, c, g, or t
tcagagtacgctatcacgaccggtgctcgatttagctcgatatagttgggtctgggagaggacgcccccgcccgttgggtttcccaggttgttctctatttggtgatcagcactgcacacagaagngtcatgacggtgttggctgagtcgttcggttttcttggttgtacgtttaagttttaaggtcgtacgtagttggtggaggtgacgacggtcgttggggtaggtggttcggggtcgggggtacgttccggttcggtaaccggcggggttcccggggttcggggggtcccctggtaaccgttccttcccgttcccgttggtacgtacgtaccgtccgttacggttcggttactttacccgttaccgtttacgtaattttagtttagtcgtaccgtagtccgtacccggttaccgggtccccggtcccggaccgtccgggtacccgtaagggggaacgggtacggttaacggtagtaattccggttgtaaccggttacggttaagttaacggttaaaagtaacggtaatacggtaaacttaaaacgtaacgttaagtttaactttaagttacaaacccggttaaaccttaccggttaaggttaaaggggtaccgggaaacgttaagttaaccgtaacccgtttaacccgtacccgtaaccgtttaacccggtaaccggtaacgtaaaacccgttaaccgtaaaaccgtaaacccggtaacgtaccggttaacttaacggtttacttaaaccgttaacggttaacgggtaccgggaccgtaacggtcggtaacggtcggtaacggtacggtaccgtaacgggtacgtaccggttacgttaacgtttaggtacggtttacgggtagggtaaagggtacggtacggggttaaaggtacggttaaacgggggtacggtttaacggggttaacggggtttacggggacgggtaaccggggtacccggg

SEQ ID NO: 267737 - DNA, 749 bp, Homo sapiens
  misc_feature: GYAE6OF01CN6CL.28.57.F02.1.454.CMB.1.raw
  modified_base (214)..(214): a, c, t, g, unknown or other
  misc_feature (214)..(214): n is a, c, g, or t
  modified_base (244)..(244): a, c, t, g, unknown or other
  misc_feature (244)..(244): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (460)..(460): a, c, t, g, unknown or other
  misc_feature (460)..(460): n is a, c, g, or t
tcagagtacgctatcacgaccggtgctcgatttagctcgatatagttgggtctggggagagggacgcccccgccctgggtttcccaggtgttctcatttgggtgatcagccactgacacacaagaagagtcagtggacgggtagttcgggctgagtcgttgggttttccttgttgtactttaagtttttaaggcgttacgaggtgtaggaggtncgagcggtgggtggtaggtcggtggggggngtccgtaggtccacggtccgggtcggggggtacctggacgactcctcgtagtgacncgtctcgngtactctactcgtaattattatgtacttanacgtaccgacggtcggtcccggacggtcgtacccgtacggaacgggtaaggtaccgtaagtaatacggttcgtacgtaacggtagttaacttaaggaaagtttaccgaagaacgtaaactanaagttactagtttacgactaacgtactacgtagaaccggtagtacgaattaccttaacactacgtacgtaacggaacgttaaccaacttaacgaaagaacccgttaaggtcccgttaataacgttacgttaaacggaacgtaggggcctaaacgtcgtaagggagttacgcgtaacggagggtccctaaggaccgtttattaaagtcggttaggagggttaagggaggaacgggtaaagtgggaaacgggttacggtaagggtagggttcgggaagggcgtaaaccggg

SEQ ID NO: 267738 - DNA, 710 bp, Homo sapiens
  misc_feature: GYAE6OF01AY61E.28.57.F02.1.454.CMB.1.raw
  modified_base (324)..(324): a, c, t, g, unknown or other
  misc_feature (324)..(324): n is a, c, g, or t
  modified_base (620)..(620): a, c, t, g, unknown or other
  misc_feature (620)..(620): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagcgttgggtttttccttgttgtcttaagtttttaaaggtgtccagtgtgaggtgcagtcgtgggtggaggtcggtgggggaggtcgttggtccgacggtccgggtcggggggtccctgacgtacttcctccgtgtcgcacgtcctcgtggacttcctaccttcgagttactttagcgtntatacgctacggtcgggtcccgcgacggccgtacggaaggggacggtacgtaggtaatatcgtgtacgtacggttagttaagtaagtagtcgactaaagtactaattaataattagacgtaactaaacgtcgtggtaggaacggtactagttaccgtaccaccgttactacccgtaccggtaaacggtaaccttaaaccgtaccgaaacgtaaccgtcgtactaacgttacgttacgttaacgtacggtacgggcgtaacgacgtacggagaccgtacgtaggacgtacgacggtnttagtattacgtggtacgggtaggacggagggtaagacgggtaaggtacgggttaacgggttagggtgggtacccggggcggtaacgggg

SEQ ID NO: 267739 - DNA, 895 bp, Homo sapiens
  misc_feature: GYAE6OF01B6Y8L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctggagtcttcggggtttttcctttggtttgtacttttaagtttttttaaaagggtcgttccgtaggttggttgggtaggttgaccaggtcgttggggtagggtaggttcggtggggggtacggtcgtttgggtcccgtaggccgggttcggggggtccctggacgtacccttcgtccgtgtcgacgtcgtccgttcgttaggtacttacctacctttactagtttagtttatcgtacctagttacgaccgttaccgggttaccggggtcccgtacccggtacggggtacccgtaaccggggaagggggttaaacgggtaccggttaaaggtaaagtttacgtttaccggttccggttaaggtttaaaggttaaagtttaaggtaaaaggttaaacggtacgtaaaacggtaaaaactttaaacggtaatttaaattttaacgtttaacggtaaccgttaaaccgttaaaccgttttaaccggttaagggaaccgggtaaacgggtaccgttaaagttacccgttaaccgtaccgttaacctaccgtaacccggtaacggttaacctaacgttaaccgaacgtactaacgtacgttagtaccttacgttaacgtaggtacgacgtacgacgtacggagtagacgtacggagacgtacgtcgttagttacgtacgttagggtaggtagggacggtagggtaggtacggttacggttaaggttacgggtcgggtttaggcggggtacggtacgggg

SEQ ID NO: 267740 - DNA, 767 bp, Homo sapiens
  misc_feature: GYAE6OF01EGV4T.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcacacagaagagtcatgacggtagtttgggctgagtcgttcgggtttttccttgttgtctttaagtttttaaaggtgtccgtagtgtgaggtgcaggcgtggtggtaggtcggtagggggaggtcgttggtccgacggtcccgggttcggggggtcccctggacgtacctccgttccgtggtacgccgacgtcccgttcgtggtacttcctaccctttactaagttacttttagtcgtacttagtcgctacggtcgggtcccgccgacggtccgtaccggaggggacggtacgtagtatagtcgtctagtagtagtaacgtaagtaatacgacgaaactaagtataattaatagtacgtaactaacgtgtagaggaacgtagaacgtacttaccaacgtaccttaccgaccggtaagtaacctaactaaccgaagaacccgacgtacgtacgttacttaactaacgtaacgtcggaacgtacgtaccgtaggtacgtacgtacgtagggaaccggtaccgacggttaccgtaagtttacgttaaccgtttaggtacggggttaagggaagggtacggggtacggtaaacgggttaaaggttacgggttaacggggtttaggggtaccgggttacggggtacgggtaacccggggg

SEQ ID NO: 267741 - DNA, 902 bp, Homo sapiens
  misc_feature: GYAE6OF01CKU5L.28.57.F02.1.454.CMB.1.raw
  modified_base (185)..(185): a, c, t, g, unknown or other
  misc_feature (185)..(185): n is a, c, g, or t
tcagagtacgctatcacgaccggtgctcgatttagctcgatatagttgggtctgggagaggagcccccgccctgggtttcccaggtgttctcatttggtgatcagcactgcacacagaacgagtcatagacggtagtttgggcctgagtcttgggtttttccttgttgtcttaatttttaaaggntccgagtgtgaggtgcagcgtggtggagtcggtgggggagtcgttggtccaggtccggtgggggtccctgaagtcctctccgtgtcgcacggcctacgtggtacttccgtacttcgagtttatttctcgtcttagtcaccgtcggttcggggccctcgtacggtccgtacccggaaggggaacggtacttagggtaacttacgttcggttacccgtaggtaaggtttaaagttaacggtaaaagttacgttacggaaacgttaaaactaaaccgtaatttaacgtttaaagtttacaacggtaacccttaaaaccgtttacggttacggttaaagggaaaggggtaacctacggttaaccttaaacccggtaacccttaccgttaccggttaaaccccggaaagggttaaacccttaaacggttaccccgaaaacggtaacccgttacccgttaacccgttaaggttaacctttaacccgtttaaacggaacggttccgggtaaacctcgttacccgggaggtaaaccgggtcggtaaaccggttgggaaacccggtacgttaacccggtagtttaacgtacggtttaaactttaccgggggtaaggggtaaggggtaacggaaacggggtaacgggtaaaccgggtttaagggttacgggtaaaaccgggttttgggggaaccccgggggttaaggggacccgggtaaacccgggg

SEQ ID NO: 267742 - DNA, 810 bp, Homo sapiens
  misc_feature: GYAE6OF01D8WV8.28.57.F02.1.454.CMB.1.raw
tcagagtacgctatcacgaccggtgctcgatttagctcgatatagttgggtcgtgggagaggacgcccccgccctgggtttcccaggtgttctcatttggtgatcacgcactgcacacagaagagtcatgacggtagtttgggctgagctgggttttccttgttgcttatttttaaagtgtccagttgtgaggtgcagctggtggagtcggtgggggagcttcggtccacgtccggtcggggggtccctgacgtactcctccgtggtcgcacgtccgtcgtggactttccgacctttctagttatttatcgctatcgcgtacggtaccgggttaccccgaccgtacggtcgtacccggtaagggggaacgggtaccgttaagggtaaattaggttacgttacccggttacgaaggtttaagttaaggtaaacggttaacgttacggaacgttaaaactaaacgtaatttaaagttaacgtttagttaacggtaacctaaaaaccgtttctaggttaaacggaaacggggtaccaaggtacttttaacccggacctaccgttcccgtaaccggaaagggttaacctaacgtttaaccgaaacgtaacctacgtacttacgtacttaacccgttagtaaacgtgggaacctacgcccgttaggacggacggacgttacggaacggtaccgaggtccttaaaggttcgttaagtttacggtaggggtagggtaaccggtaagggtaggtacccggttaaagggtttacggtaacgggttagggtttccggggtacggggaccgtaacgggggg

SEQ ID NO: 267743 - DNA, 635 bp, Homo sapiens
  misc_feature: GYAE6OF01CP50V.28.57.F02.1.454.CMB.1.raw
  modified_base (253)..(253): a, c, t, g, unknown or other
  misc_feature (253)..(253): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (485)..(485): a, c, t, g, unknown or other
  misc_feature (485)..(485): n is a, c, g, or t
  modified_base (495)..(495): a, c, t, g, unknown or other
  misc_feature (495)..(495): n is a, c, g, or t
  modified_base (524)..(524): a, c, t, g, unknown or other
  misc_feature (524)..(524): n is a, c, g, or t
  modified_base (576)..(576): a, c, t, g, unknown or other
  misc_feature (576)..(576): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatggacggtagttgggctggagtcttgggttttccttgttgcttaattttaaaggtcgtccagtgtgaggtcgcagcgtgggtggagtcggtgggggagtcgttcggtccaggccggtgggggtcccnggacgctctccgtgtcgctagtccttagtggtacttacctacttataagttaatttagacgtctagtcgtactacgtcgggtcccacgaggtcctacggaagggtaggactaggaatactactctaggtagttaataagaacgttanagtaagaaatataatattaataganactaatcgtaggtacgaggactatacactactacgtctaacggaagactaactaacgaanaccgtacgtntactctataacgagaggaccaggtaaccnggaactgacaggacggacctggttaactaggtaacttgtacgtagggacggngaagggtcgaacggtaaaggttacggaaacggttggggtacgtcgggggcgtaaccggg

SEQ ID NO: 267744 - DNA, 877 bp, Homo sapiens
  misc_feature: GYAE6OF01BH8WW.28.57.F02.1.454.CMB.1.raw
  modified_base (821)..(821): a, c, t, g, unknown or other
  misc_feature (821)..(821): n is a, c, g, or t
  modified_base (832)..(832): a, c, t, g, unknown or other
  misc_feature (832)..(832): n is a, c, g, or t
tcagagtacgctatcacgaccggtgctcgatttagctcgatatagttgggtctgggagaggagccccgccctgggtttcccaggtgtctcattggtgatcagcactgcacacagaagagtcatgacggagtttgggcctgacgctgggttttccttggttgcgtatttttaaaggtgtccagtgtgtaggtgcagctggtcggagtctgggggagcgttggtccagtccgtgggggtccctgagtacctcgtaccgtggtcgtcgacgtccgtacgttcgggtactttaccaccgtttacgaacggttaagtttttaactcggtaccttaagtttcggacccgttaaccggttcggggttcccccggtaccgtaacggggtccctttaccgggaaggggggaaaccggggtaccgttaggggtaaaccttaaggttcggttaccgtcccggtaagggtttaactttaacgggtaaaacggttaacgttacggtaaccgtaaaccgttaaacgtaagtactttaagtttaactcgggaaacctaaaccgttcggttacggtaggttaacggggaccgtaaacgggttaccttacccggaaaccgttacgttaccgttaacccgggtaaccgggtaaacttaaaccgtttaacccgaaaacggtaacccgtacccggttaccggtttacggtttaaacccgttccgttttaaaccgaaaggtttccggggaacccgtaggtacccggtttagggaaccgggtacggtaccggttaaggacccgggtaactacgggtaccgttagttaacgttacgtttcgggngttagggtagnggacgtacggagttacgggacgttagggttcggtgggccgtaggg

SEQ ID NO: 267745 - DNA, 822 bp, Homo sapiens
  misc_feature: GYAE6OF01DSOLF.28.57.F02.1.454.CMB.1.raw
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgtcttatttttaaaggtgtccagtgtgaggtgcagcgtggtggagtcgtgggggagtcgttggtccaggtccggtcggggggtccctggagtccttcctccgtgtcgcacgccttcgtggtacttcctaacctttcgtaagtttattttaactgcttagtcgactacggttcggggtcccaccgacggcctaccggaaggggaacgggactaggtaaacttntcgtactacgtaaggttaattaaggaaatagtcgaacgtaaactaaataacttattaagtttacgtacgtaaccaaacgttcgtaggggtaaacggaacgggtaactaaggtttaaccttaccgaaacccctacgttcccttaaacccggggaaacgggtaaaccttaaacgttaacccgaaacggaaccctacggttcctaagttttaaccttaccgtttaaacggaaacggttccggggaactaacccgggtccgttaaagggaacggcggttaccgtaacggggaaccgtacggaccggttaccgtttaaggttaaactttcggttaacggggtggttacgggggaaaggtaagggtaacgggtacgggtttaaaaggttcgggggtaaaagggtttgggggtttacgggcccgggggtaccggtaaaccgggg

SEQ ID NO: 267746 - DNA, 858 bp, Homo sapiens
  misc_feature: GYAE6OF01AOC2N.28.57.F02.1.454.CMB.1.raw
  modified_base (122)..(122): a, c, t, g, unknown or other
  misc_feature (122)..(122): n is a, c, g, or t
tcagagtacgctatcacgaccggtgctcgatttagctcgatatagttgggtctgggagaggagcccccgcccttgggtttcccaggtgttctcatttggtgatcagcactgcacacagaagngtcatggacggtgttcgggctggagtcgttgggttttccttgttgtcttaagtttttaaacggtcgtaccgtagttggtggaggtgacaggtcggtgggtcggtaggtcggtagggggtcgtcggttcggtccgacggtccgggttcgggggtcccgtaggacgtacgttccgttccgtggtcgccgacgtcctacgttcggtacttcccttaaccgttcgttaagtttactttagtcgtacttaacgtcggcgttaccggttcggtccccggacgtacggtccgtaaccggggaaggggaacggtacgtaggtaaacttcggtcgttacgtaggttaaacggtttaagtaaacggtaagtacgtacggtaacgtaaaataacgttaattactaacgttacaacgtaacctagttacgtagggtaacgacggattaactctaactacctaccggtaacgtaacccgtaaacggtaacctaaaccgttaacccaaacggtaaccgtacgttacggttaacgttaaaccctttaacggttaaccgaagggtaccggtaactaccgttaacggtacgacggggtaacccgtaggtacccggggtaagtacccgtagggttacttacgttaaacgttaggttacgggtcggaagggttacgggtacgaaaggttaaccgggttaggtaaccgggggtagggtttaaccggggtggggaccccgggttagggtacccgggg

SEQ ID NO: 267747 - DNA, 799 bp, Homo sapiens
  misc_feature: GYAE6OF01BGXKI.28.57.F02.1.454.CMB.1.raw
  modified_base (504)..(504): a, c, t, g, unknown or other
  misc_feature (504)..(504): n is a, c, g, or t
  modified_base (684)..(684): a, c, t, g, unknown or other
  misc_feature (684)..(684): n is a, c, g, or t
  modified_base (730)..(730): a, c, t, g, unknown or other
  misc_feature (730)..(730): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagtcttgggtttttccttgttgtactttaagtttttaaagggtcgtaccaggtggttggaggtgctagcgtgggtggtaggtcggtgggggagtcgttcggtacccgagtcccgggttcggggggtccctaggtacgtaccttccttccgtgtacgcgtacgtccgttcgtaggtacctttcctaccctttagtagttatttagtacgtaccttagtcgaccgtacggttccggggtaccccgccggtacggtcccgtaccggggaaggggtaacgggtacgtaggtaacttacgtcggtcctaaggtagttaaacgttaagaagttagtacgagtaaactaacgtattaacttagttaanacgtacgtaaccgtgtaggtaacgggtaaaggtctaacgttacttacccaaccgttaccgtccgtaaccggggaaacggtaaccttaaacggttaacccaaacgtaacccgtaaccggttccttaagttaccttaaccgttaagtaaacgggtcggaacgttcggaaccgtaggtaacgnggtacgtaacgggacgacgtcggtactacggttatacggtttaagnggtaagggaggcgggtagtaccggtaagttagggtaaccggttagggaccggggtgggccggtacgggg

SEQ ID NO: 267748 - DNA, 861 bp, Homo sapiens
  misc_feature: GYAE6OF01DUL7L.28.57.F02.1.454.CMB.1.raw
  modified_base (177)..(177): a, c, t, g, unknown or other
  misc_feature (177)..(177): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggngtccagtgtgaggtgcagcttgggtggagtcggtggggggaggtcgttcgggtccaggcccggtcgggggggtcccctggacgtacctctccgtgtgcacgtcctcgtggtacttccacctttacgtagtttattttacgtcggtacttacgtcgacctaaccggttccgggggttaccccgacccgtaacgggtcccgttacccggggaaggggggtaaaccggggtaccgttaagggtaattacggttcggttaccgttacggtaaggtttaaagttaaggtaaacgttaagtacggaaacgtaaacttaaacgtaattaagtttaagtttaacgtacggtaacctaaacgttccgttagggtaacgggaaagggtaccgtaagtacgttacccaccgtaaccgttacccgtaaccggtaacgggtaacctaaaccgttaaccgaaaccggtaaccgtaccggtaccgttagttaaccttaccgttaacgaaggtccgggtaacgtaacgtaccggtaggtaaggtaccggtcggtaacggacggaccggtaaccggtacgttaggttaacgttacggttacggtcgggtaacggggaacggtacgggtaacgggtacggttaaacggttcggggtaaacgggttagggggtttacgggacggggtacgggtaacccggggg

SEQ ID NO: 267749 - DNA, 820 bp, Homo sapiens
  misc_feature: GYAE6OF01D5UBK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggagtcttggtccagtccggtgggggtccctgagacctcctccgtgtcgcacgtcctcgtggtacttccacctttcagtttatttagtgtaccttatcgacctacggtcgggtcccgaccgaggtccgtaccggaaggggaacggtacgtaggaattagtgtccgtacgaaggttaacttaaggaagttaagtaggaacgtaaaattaaacgtaattaatttaactttaaagtacgtaaccttaaaaccgttcggtaggttaagggaaacgggtactaaggttaacttacccgtaaccctaagttaccccgttaaccggtaaacggggtaaacctaaaccgtttaaacccgaaaagtaaccctaaccgttaccgttagttaacctttacccgttaaacgaaacggtcgggaaccgtacggtacccgttaggaacggtagtacccgtagggaaccggtaccggaacgttcgttaaggtactttaacggtttacggtacggggtaagggaacggtacggggtaaacggtaacggggttaaaacgggtttacggggaaaacgggttttaggggggttacgggtccgggggaacccggggttaaaccggggg

SEQ ID NO: 267750 - DNA, 803 bp, Homo sapiens
  misc_feature: GYAE6OF01B13MN.28.57.F02.1.454.CMB.1.raw
  modified_base (173)..(173): a, c, t, g, unknown or other
  misc_feature (173)..(173): n is a, c, g, or t
  modified_base (675)..(675): a, c, t, g, unknown or other
  misc_feature (675)..(675): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgcttattttaaggntccgagtgtgaggtgcagcgtggtggagtcgtgggggagtcgttcggtccaggtccggtcggggggtccctggacgtacctccgtccgtgtcgctacggtcctcgtggtacttcctacctttcgtaagttatttatcgtacttagtcgaccgtaccggttcgggtacccaccgtacggacccttaccgggaaggggtaacggtaccgtaggtaaacttcgtacggttctacggtaaggttaacttaaggtaaacgtaagttacggaactaaacgttaaactatttaacgttaacgtttaacgacgtaacctaaaccgtttcgttacggtaagggaaacggtctaaacggttccttaaccgaccttaagtccccgtaacggaacggtaaacctaaccgttaaccgaaacggaccgtaacgttacgttacgttaacttaccgtttaacgaagggttccggctacgtacgtaggacccgtgtcgtaacgggacgtacgacgggtntttaagtaacttacgggttaacggttgggaaagggacgggtaacggggaaacggtaccggtttaaagggtttaaccggggttaaggttacgggggttcgggtacccgggggaccggttaaacccgggg

SEQ ID NO: 267751 - DNA, 686 bp, Homo sapiens
  misc_feature: GYAE6OF01CMX55.28.57.F02.1.454.CMB.1.raw
  modified_base (312)..(312): a, c, t, g, unknown or other
  misc_feature (312)..(312): n is a, c, g, or t
  modified_base (584)..(584): a, c, t, g, unknown or other
  misc_feature (584)..(584): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggttttccttgttgtcttaagtttttaaaggtgtccagtgtgaggtgcagcgtggtggagtcggtgggggacgtcgttcggtccgaggtccggtcgggggtccctggacgtccgttctccgtgtcgaccgcgtccgttgtggtactttcccaacccgtttntagttatttacgtgtacctagtcgcctcggtcgggtcccgcgacggtccgtaccggaaggggtacgtacgtaggtaaactgttcgttacgtagtaggttaacgttaaggaacgtagtacgaacgtaaaataaccgtaagttacttataagtacgtaactaacgttcgtaggtacggaggactagtactcaactactaccgacgaacgtactaacgtacgaaacacgtacgcttagtacttacgtacaaggtcgcgacgtacgaggacgtagngtaacggacgtacgacgttctagtacgttacgtggtacggtaggaacggtaaggtaccggtagttaacggtggtacggttagggcggagggtcgtaccgggg

SEQ ID NO: 267752 - DNA, 805 bp, Homo sapiens
  misc_feature: GYAE6OF01AMP5Y.28.57.F02.1.454.CMB.1.raw
  modified_base (196)..(196): a, c, t, g, unknown or other
  misc_feature (196)..(196): n is a, c, g, or t
  modified_base (670)..(670): a, c, t, g, unknown or other
  misc_feature (670)..(670): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttagtttttaaaggtgtaccagtgtgaggtgnagcgtggtggagtcggtgggggagtcgttgggtccgaggccggttcgggggggtccctaggacgtaccttccgtccgttggtacgccgacggtcccttcgtcggtactttcccgaacctttcgtagtttaattttatcgtacttagtcgtacctaccggttcggggtccccgaccggtaccggccgttaccggaagggggtaacgggtacgttagggtaaattgtacgttcgtacggttaaggttaagttaagtaaagttacgtagaacgtaaactaaagtattaagttatttacgtagtaacctaacgttgttaggacggtaacggtactaagtaccttacgaaccttcgtaccgtacgaacggtaactaactaaccgaaactaccgacgttacttacgtacttaccttaacggaacgtcgggtaacagttacccgaggaaatcgggtacttgggaaaccggactaacgggtnttaagggttaccttaaaggtttaccgggaggggttaggggtaaagggcgggtaaacgggtaagggtttaaacgggttacgggaacggggttttaagggggtcggggtaaacccgggggtggttaaaccccggggg

SEQ ID NO: 267753 - DNA, 939 bp, Homo sapiens
  misc_feature: GYAE6OF01DM1C2.28.57.F02.1.454.CMB.1.raw
tcagagtacgctatcacgaccggtgctcgatttagctcgatatagttgggtctgggagaggacgcccccgccctgggtttccccaggtattctcatttggtgatcagcactgcacacagaagagtcatgacggtagtttgggctgagtcgttgggtttttccttgttgtactttaagtttttaaaggtgtcctagtggtggacggtgcagtcgtgggtggtaggtcggtgggggacgtcgttcggtccgacggtcccgggtcggggggtccctaggacctaccgttcctccgttgtacgccacggtcccttgtcggtacttccctaactttcgtaatttacgtttactcgtcttagtcgccgtacggtccgggtacccgccgtacggccgtaccgggaaggggaacggtcgttaggtaagtacgttcgtacgttacgaaggttaataacgggtaagttaagtacggaacgttaaaactaacttaattaataagttacgtaacgtaacctaacgtttcgtaggagtacggtcgggtaactcgttaacgtacccgtaacttacgttaccctaacgggttaaccggtaacttaaaccgtaacccgtaacgtaacccgtaaccggtccttttaaaggttacccgtttaactttaaacggaacgggttccgggtaaccgttaacccgggtccggttaaacgggtaccggtacgggttaacccggacggggttaaaccgggtaccggtaaccgggttttacgttaaaaccgggtttaacgttttaaccgggtttacgggttaaccggggggtaaagggggtttaaaccggggaaccggggttaaccgggtttaaaacgggggttaaacccgggttttaaacggggtttaacgggggtttaacggggggtttacccgggggaacccggggggttaaacccgggggg

SEQ ID NO: 267754 - DNA, 813 bp, Homo sapiens
  misc_feature: GYAE6OF01E0GB2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctatttttaaaggtgtccagtgtggaggtgcagcgtgggtaggacgtcggtgggggaggtcgttcgggtccaggtccggttcggggggtccctggacgtactccttccgtggtcgcgacgtcctcgttaggtattccctaaccgttctaagttttactttagcgtacctagtcgtcctacggttccggggtcccgaccaggggtccctaccgggaaagggggtacggggtacgtacggtaagttacgtcgtccttagtaaggttaaggtaagtaaacggttaagacggtaacgtaaattaaacggtaacttaatttagttaacacgtaacgttaaacctccgtaggttacggaacgggtactacgtactaccgtaacctattccgtaccggaagggtaaacctaacgttaccgaaacacctacgtacgttacgttacgtacctaacggttaacgtcggtaccgccggttaactaagggacgtacgtacgtagggtaacggacgtaaccggttccgtaaggtttaacttaaaccgttacgggttacgggtaaggggtaacggtagggtaacgggacggttaaacgggttaaccggggttaaacgggttcgggggttaaccggggcggggggttacccggtaaacccgggggg

SEQ ID NO: 267755 - DNA, 889 bp, Homo sapiens
  misc_feature: GYAE6OF01EZG4R.28.57.F02.1.454.CMB.1.raw
  modified_base (123)..(123): a, c, t, g, unknown or other
  misc_feature (123)..(123): n is a, c, g, or t
tcagagtacgctatcacgaccggtgctcgatttagctcgatatagttgggtctgggagaggagcccccgcccttgggtttcccaggtgttctctatttggtgatcagcactgcacacagaagngtcagtgacgggtagtttggctggagtcgttgggtttttccttgttacgtactttaagtttttaaggcgtcaggttgtaggaggtgacgagtcgttgggtaggtagttccgggtgggggacgtcgttacggtccgacggtccgggtcggggtaccctggaccgtacgtcctccgtgtcgactcgtcctgtcgtactcctaccgttagtagttacttagtcgtacgtacgtcggtaccggtccggtttaccgggaccccaccggtacgggtcccgttaacggggaaacggggtaacggtacgtttaacgaacgtttacgttcggttaacgtaacggtttaaggttaaagtttaaacggaagtttaagaccggtaaacgtaaattaacgtaagtttaatttacgttaaccgactaacgttaacccgtggtacggtaaacggaaggtactaacgtttacgtacctaacccgtacgttacccgtaaacgggtaacctaaccgtaacctaaacgaaccgtacgtaccgttactacgtttaactaccgtaacggtaggccgttaaccgtaccggtagtcggaacggtcggtaacgtaccggtaacggtaaccggttacgttacggtttaaccgttaacggtaacggttcggggtaaacgggtacgggtaacgggtacgggtttaaaccggtacggggttaaacgggtttaacgggggtaacggttttaagggggccccggggttaacgggtaacccggggttaaacccgggg

SEQ ID NO: 267756 - DNA, 997 bp, Homo sapiens
  misc_feature: GYAE6OF01C56ZZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgcttaatttttaaaggtgtccagtgtgaggtgcagcgtggtggagtcgtgggggagtcgttcggtccgaggcccggtcgggggggttcccctaggaacgtacccgttcctcccgttgtcggccaacggtccccttccggtggtaacttttccctaacccgttttaccaagtttaattttaacttggtaccttaagttcgacctaaccgggttcgggggttaccccgaccggtaacgggtccgttacccgggaaaggggggaaacgggtaaccggttaggggtaaactttaaggtttcgggttaccgttaaccggtaagggttttaaacgttttaaaagggtaaaaggttaaagtttcgggaaaaccggttaaaaactttaaaaacgtaaaattttaagttttaaaagttttaacgtaggtaaacccttaaaacctttcgggtaagggttaaaccgggtaaagggaccgttaaggttaaacttttacccgaaccccgttaaaccgttacccgtaaccccggtaaacgggtaaacccttaaaacgtttaacccgaaaaccgtaaacccgtaaccgttacgttaacgtaaccgtttacccgtttaaacgtaaacgggtttacggggaacccgtaacggtaacccggttaagggaacggttaccgggaacggttacggtaaccgggtacggtacccggtacggtttaagtaaacgtttacgtttaacgggtagggttaacggggtagggtaaacgggtaagggtaaccgggtttaagggtaaagggtttaaccgggttaggggggttttacgggaccggggggtcgggtaaccggggg

SEQ ID NO: 267757 - DNA, 949 bp, Homo sapiens
  misc_feature: GYAE6OF01C74P4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacaagaagagtcagtgacgggtagtttgggctgagtcgttgggttttccttgttgtcttaatttttaaaggtcgtcagtgtgaggtgacagtcgtagggtggaggtcggtgggggaggtcgttcggtccgaggtccgggtcgggggggtcccttaggacgtaccttcgtccttggtacgccacgtccgtacgtggaacttcctaccttactaggtttactttaatcggactacgtcgacgtaccggttcggggtccctccggggaacggtcccgtaccggggaaaggggtaacggggtaaccgtagggtaacttagttacggtttaccgtcggttaaggttaaaagtttaggaaaagttaacgtacggttaaaccggaaaatttaaaccgtaagttaatttaaatttaacgggaactaaaccgttaacggttaccggtttacggggaaggtaaacgggtaccgtaaaggttaacgttaaccccgaacccgtttaaccgttacccggtaaacccggggtaaaccgtaaaccgtttaaacccggtaaacccgtaaaaccggaaccgtaaccgggttaaccgtttaacgtaccttttaaccgtttaaacgtaaccggttacgggaacccgttaaagccccggttaaggtaacggtaacgggtccgtaaagggtaccccgggtaccgggttaacgttaaccggttaggttaaacctttaggggttaacccggtttggggtaacggggtaagggtacgggggtaaaaggtacgggttaaaggtttaccggggttaaacggggttcggggggttacgggcgggggtaacccgggtaacgggg

SEQ ID NO: 267758 - DNA, 746 bp, Homo sapiens
  misc_feature: GYAE6OF01AWTKW.28.57.F02.1.454.CMB.1.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
tcagagtacgctatcacgaccggtgctcgatttagctcgatatagttgggtctgggagaggagcccccgccctgggtttcccaggtgttctcatttgggtgatcagcactgcacacagaagagtcatgacggagtttgggctgagctgggttttccttgttgctattttaaggtgtccagtgtgaggtgcagctggtggagtcgtgggggagtcttggtccagccgtcgggggtcccnganaccgtctccgtgtacgctacgccgtcgtggtattccgacccttttcgaagttactttatcggtactatcgacctacgtcggtacccgcgacggcctaccggagggaacgggtctagggatacgtcgtctagtacggttattaaggaagtagtcgacgtaactaactataataattatcgaactaaactcgtgtaacggaggtacgaagtacttaccactactaccgtcgaacgggtaactaacttaccgaaacgtaacctacgtaccgttcgtacgttacctaaacgtacggtaccggcgtaacggtaccggtaacggacggtaaggtacccgttaagggaacccgggtaaccgtaacgggtaacgttacgggttaaacgttaaacccgtttaagggtcgggttacggggaagggtacgggtaacgggtacggttaaacggggttaaacggttaaccggggttacggggttacgggtaccggggggttaccgggtaaacccgggg

SEQ ID NO: 267759 - DNA, 749 bp, Homo sapiens
  misc_feature: GYAE6OF01BNCRD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgacgtactctcctgtgcagcctcgtggtacttccacctttcagttacttttatcgtacttatgcctaccgtcgggtccccgccgtaggccttaccggaagggggaacgggtaccgttagggaacttagttcgtccgttacgtaacggttaattaaaggaacggttaacgtacggaacggtaaaacttaacgtaattaatttacttaagtcgaacctaaacttcgtagggtacgaaggggtactaaggttacgtttaccaacccgttattacccgtaacccggtaacgggtaaccttaaaccggttaacccgtaaaacggaacccgttaaccggtacccttaggtttaacctttaccgttaacgtaaagtccgggacaacgtccgtaggtacgagtccgtagacggacgtcggcttacgttatacgttacggtgggtagggaggtacgggtacggtacggtaaggttacgggaacggtttagggggtcggtccgggggacgtaacgggg

SEQ ID NO: 267760 - DNA, 822 bp, Homo sapiens
  misc_feature: GYAE6OF01A8O02.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgtcttaagtttttaaaggtgtccagtgtgaggtgcagcgtggtggaggtcggtgggggacggtcgttgggtcccaggccggtcgggggggttcccctggacgtaccttcctccgtggtcgccacggtccttcgtaggtacttacctaccctttacaaggtttattttaagtcgtactatcgctacggtcgggtccccgtccgaacggtccgtaccggaaggggtaaacgggtacgttaagggtaacttacgttcggttaccgttaccggtaagggtttaagtttaaaggtaaaggttaagtacggtaaacgtaaaacttaaactaagttaaatttaactttaacgtagtaaacctaaaccgttgttaacggttaagggaaacggggtaccaaggttaacctcccaaaccgtacttaccccgtaacggaacgggtaaactaacgttaaaccgaaagtaacccgtacgtacgtttacggtaacttccgttaaactaagggtcggtacctaacggtcccgtaggaacggtagtaccgttaggaacgggaccgtacgggtaccttagttaaacgttcgttaacggtggggtacggaacgggtaggacgggtacgtaaggttacgggaacgggtttaggggtcgggtcggggccggtaacggggg

SEQ ID NO: 267761 - DNA, 776 bp, Homo sapiens
  misc_feature: GYAE6OF01B60BV.28.57.F02.1.454.CMB.1.raw
  modified_base (167)..(167): a, c, t, g, unknown or other
  misc_feature (167)..(167): n is a, c, g, or t
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (463)..(463): a, c, t, g, unknown or other
  misc_feature (463)..(463): n is a, c, g, or t
  modified_base (475)..(475): a, c, t, g, unknown or other
  misc_feature (475)..(475): n is a, c, g, or t
  modified_base (489)..(489): a, c, t, g, unknown or other
  misc_feature (489)..(489): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttctgtgctattttaagngtcagtgtgaggtgcagcgtggtggagtcgngggggagcgttaggtccnggtccgtgggggtcctgacgactctcgtagtcgctagccgtctggacttcgtaccctttgtagttaagttttatcggtcttaatcggtacctaagttccggggtccccaccgtaacggtcccgtaccggaagggggtaaacggggaccttaggggtaaaatttcaccggtttcgtaaccgggtttaaggttaaagtttaaaccgggtaaatttaacggttacgaaacccggtaaattaaaacccgtntttaaacgtttnttaaagtccgtaanaaaacccgtttggttacggaagggttaaccggactaagttactaccctaaccgttactaccggtaccgaaagggtaaccctaacgttacccgaaagaaccgtacgtaccgttagtattacccgttagaaggtccggacacgtacccgtagacggtagtcgtggaacgggtcaaccggtcggttactagttaaggtcggttgggaaggggacggtcggaaggggtaaccgtttagggtaaccgggttagggtttaacgggtcgggggtaccgggccgggtacccgggg

SEQ ID NO: 267762 - DNA, 759 bp, Homo sapiens
  misc_feature: GYAE6OF01A5FNQ.28.57.F02.1.454.CMB.1.raw
  modified_base (191)..(191): a, c, t, g, unknown or other
  misc_feature (191)..(191): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtncagcgtggtggagtcgtgggggagcttggtccagccgtgggggtccctgagactctccgtgtcgcacgtcctcgtggtacttacctacctttctaacgttatttatcgtactagtcgcctacggtcgggtcccgccgaacggtccttacccgggaaggggtaacgggtacgtaggggtaaacttagttacggtccttaacggtaaggtttaagttaacggtaaagttaacgtacggtaacgtaaaattaaacctaattaacgtttaatttagtacgtaacctaaacgttccgttaggtacgggaacgggtactaagtaccgttaaccaccctagttcccgtaccgaacggaaccttaaccttaaccgaacgtaacctaccgttacgttacgttacttaaccttaacgaaggtcggaacctacgtaccgtaggacgagtacgtacggacggtaacggtccgacgttagtaagttacttacgggtggtaacggggaaggtagggtacgggacggttaaaggtttacgggaacgggttagggggtttgggacccggggtacggtaccgggg

SEQ ID NO: 267763 - DNA, 749 bp, Homo sapiens
  misc_feature: GYAE6OF01AGGLN.28.57.F02.1.454.CMB.1.raw
  modified_base (326)..(326): a, c, t, g, unknown or other
  misc_feature (326)..(326): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagttgggctgagtcgttgggttttccttgttgtcttaagtttttaaggtgtcctagtgtgaggtgcgagcgtggtggtaggtcggtgggggacgtcgttcggtccgacggtccgggttcgggggtccctggacgtacctcgtccgtagtcgcgtacgtcctcgtgtacttacctaccttacgtagttatttancgtactagcgtcgtaccggtcggtcccgacgacgggtacctaccgggaaaggggtaaccggtagtaaggtaattacgtacggtaccgtaggtaaggttataaaggtaacgtaagtacggaaactaaaacgtaacgtaattaataagttagaacgttaaccgtaaacgttcggttaaggtaacgggaacggttactaacgttccttaaccacgttacgtacccgtacggtaaacgtactaaaccggtacaaacgtacctagtcgttaacgtactacgtaaccgaagtcccgggaaactgaaaccgtgtaagtcggtaccgtagaaccgtaccgtgttaactgttaacgtgttacggcgggtaaggaggtaggtacgtaggttaacggtcgggttaacgggttggacgggcgggtaaacgtcggg

SEQ ID NO: 267764 - DNA, 938 bp, Homo sapiens
  misc_feature: GYAE6OF01B0FRU.28.57.F02.1.454.CMB.1.raw
  modified_base (190)..(190): a, c, t, g, unknown or other
  misc_feature (190)..(190): n is a, c, g, or t
tcagagtacgctatcacgaccggtgctcgatttagctcgatatagttgggtctgggagaggacgcccccgccctgggtttccccaggtgttctcatttggtgatcagcactgcacacagaagagtcagtggacggtagtttgggctggagtcgtttgggttttccttgttgtactttaagtttttaaggngtaccaggttgtggaggtgcgtagcggttaggtggtaggtcgggtagggggaggttcgttacggtcccgacggtccggggttccgggggttacccctaggacgtaccttccgttccgttggtacgccgtacggtcctacgttacggtcttacctaccgttacgtaagttacgttttagcgtactacgtcgaccgtaccggggttcggtccccgaccggtacggtcccgttaccggggaaggggaacgggtaactaggtaacttacggttccgtacgtaacggttagtttaaagtaaaggtaacgtagtaacggtaaagtaaaacgttaactaatttataaacgttacgtaacgtaaacccttaaagtacggttagggtaaacggtacgggtacttaacggttacctaaccgaacccgttacttaccccggtaaaccgggtaacggtaaacctaaaccgttaaccggaaaacccgtacgtaacgtccgttaatttaaccgtttacgtaacggtaacgtccgggtaacgtacgtacgtagggtaacgtacgtaagggtaccggtaacggaccggttacggttaaacgtacggttttaaacggttaccgttttaacgggggtaggggtaaagggtaaacggggttaaagggtaaccggggttaaacggttaaacgggggttaaccggggtttaaggggggtttaccggggttaacgggggttaaccggggtaccgggttaacccggggggg

SEQ ID NO: 267765 - DNA, 779 bp, Homo sapiens
  misc_feature: GYAE6OF01D2GHU.28.57.F02.1.454.CMB.1.raw
  modified_base (380)..(380): a, c, t, g, unknown or other
  misc_feature (380)..(380): n is a, c, g, or t
tcagagtacgctatcacgaccggtgctcgatttagctcgatatagttgggtcgtgggagaggacgcccccgccctgggtttcccaggtgttctcatttggtgatcagcactgcacacagaagagtcagtgacggtagtttgggctggagtcgttcgggtttttccttggtttgtactttaagtttttaaacgggtcgttccgtaggttggttgaggttgcgagtcgtgggtggagtcgggtgggggagtcgttcggtccgacggtccgggtccgggggttccctgtaccgtcctccgttccgtgcgccgaccgtcccgtggtacttacctacccgttatagttattgtagtctagtcgcgtcggttccggtccgacccgnggtacccgacgggaaggggtaacggagtacggaattcgttccgtgtacggtaaggtttaagtaagaagttagtacgaaacgttaactaagttaatactttatctaacgtaataccttagtacggtagacggatacgttacgtacctacgtacgtaccgtaccgtaacgtaactaaacgttaacgaaacgtaaccgtaccgttacgtacgttacttacgttaacgtaacgtcggaccgtacgtcgtaagtacggtaggacggtaacggacgttaaccggcgttaagttacgtacgttaagttccggtaagggttaggaggggttaacggacggttaaccggtaaggttaacgggtacgggtacgggttacggggacgggttacggacgggtttacccggg

SEQ ID NO: 267766 - DNA, 1085 bp, Homo sapiens
  misc_feature: GYAE6OF01B4U43.28.57.F02.1.454.CMB.1.raw
  modified_base (218)..(218): a, c, t, g, unknown or other
  misc_feature (218)..(218): n is a, c, g, or t
tcagagtacgctatcacgaccggtgctcgatttagctcgatatagttgggtctgggagaggagcccccgccctgggtttcccaggtgttcctcatttggtgatcagcactgcacacagaagagtcatgacgggtagtttgggctgagtcgttgggttttccttggttgtctttaagttttttaaaggtcgttacctaggttggtaggtaggtgaccgnggtcgtgggtggtacgttcgggtggggggacgtcgttcggaccgacggtccgggttcggggggtaccctggaacgtccttccgtccgtggtcgccgacgtccgttcgtacggttacttccctaccgtttacgtaagttttaactttacgttacgtacttacggtacgtaccgttaccgggtaccgggttcccgaccggtaccgggtacccgttaccggggaaagggggtaaccgggtaacggttaacggtaaacgtttcgttaccggttacggttaaccgggttaaagggtttaaacgtttaaacgggtaaaggttaaacgtacgggtaaaacttaaaacgttaaaacgttaagtttaatttaacggtttaacgaaaccgttaaaccgttaaccgtttaagggttaacggtaaacccgggtaacgggtaaccgttaacgttaacccggtttaaccccgaaccgtttaccgtttaaccccgggtaacggttaaaccgggttaaacccttaacgtaaaaccggaaaacccgggtaaccttaacccgtttagttaacccggttttaacctaaccggtttaaaacgaaccggggttttcggggaaaccctttccgggtaaccggttaaacgggttcgtaaaacccccggggtttaggaaacccgggttaaccgggtaccccggttaaagggtttacccgtttaaaacgggttccggttttaaaaagggttcccggggttaaaggggggttaaaggggacccgggtttaaaggggggtaccgttaaaaggggtttaccggtttaaacggggtaacgggggtttttaggggggtacccgggggtacgggggttacccggtaaaccccgggggg

SEQ ID NO: 267767 - DNA, 815 bp, Homo sapiens
  misc_feature: GYAE6OF01DAHLO.28.57.F02.1.454.CMB.1.raw
  modified_base (709)..(709): a, c, t, g, unknown or other
  misc_feature (709)..(709): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcgttgggtttttccttgttgtcttaagtttttaaagggtcgttccagtgtggaggtgcgagtcgtgggtggagtcggtggggggagtcgttcggtccgagtccggtcgggggtccctgacgtctctccgtgtcgcagccgttcgtagtacttccgtacctttctaagttactttattcgtactatgtacgtcgtcggggtcccgccgacggtccgaccggtaagggggaacggtacggtaggtaattgttacgttcgtaacgttaagggttaagttaaggtaaaggtaattacggtaacgtaaaataaacgtaaattaatttaattagtaacgtaacctaaaccgtgttaggtaacggtaaggacgtaacgtaacttaccccgaacccgtaattccccccgtaaacggtaaaacggtaacccttaaaaccgttaccgaaaaccggaaccttcccggtaaattttcgtaaacccttttaacggtaaccgtaaagggtccgtaacggttaccggaccttaagggaccggtacgtacgacggggtaactaccggtacgggtacttntaaaggttacgtttgggaacggggtggaaagggtacgggttaagaaggtaaccgggtttagggaaacggggtttaggggcggggtacccggggtcgggtaaccggg

SEQ ID NO: 267768 - DNA, 845 bp, Homo sapiens
  misc_feature: GYAE6OF01D90ED.28.57.F02.1.454.CMB.1.raw
  modified_base (830)..(830): a, c, t, g, unknown or other
  misc_feature (830)..(830): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcagtggaacggtgtttgggctggagtcgttgggttttccttgttgtactttaagtttttaaaggcgtaccgtagtgtggtaggtgcgagtcgtgggtggtagtcgggtgggggagtcgttcggtccgtacggccggtcgggggtccctggacgtcctcgtccgtgtcgccgtacgtcctcgtagtcttcctaccttgtagttattacgtgtctagtcgacctccggtcggtcccgaccggcggtacccgtacgggaacggggtaacggtaccgtaaggtaacttgttacgttccgtaaggtaaggttaacgtaaggttaaagtacgtaaacgaacgttaaaagttaattaaagtttaattaagttaaccgtacgtaaaccttaaccgttaggttacggtaacggtaacgggttactaaaccggttacctaacccctaagttaaccccgtaaccggttaaacccgggtaaactaaaccttaacccggaaaccgaaagtaacccgttcgtaagtttaccttaacgttaaccgtaaaggttcgacggtactacggacgttacggaccgtggtaacgtacccgggatacggtaaccgtaaggttcgtttaacgtagggttacgggaagggtagggtaacgggtaaggtacccgggtaaaggtttaaaccggggttaggtttacggggttagggcccggggttaaccgggngggttaaaccccggg

SEQ ID NO: 267769 - DNA, 720 bp, Homo sapiens
  misc_feature: GYAE6OF01B7NW7.28.57.F02.1.454.CMB.1.raw
  modified_base (115)..(115): a, c, t, g, unknown or other
  misc_feature (115)..(115): n is a, c, g, or t
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (287)..(287): a, c, t, g, unknown or other
  misc_feature (287)..(287): n is a, c, g, or t
  modified_base (642)..(642): a, c, t, g, unknown or other
  misc_feature (642)..(642): n is a, c, g, or t
  modified_base (711)..(711): a, c, t, g, unknown or other
  misc_feature (711)..(711): n is a, c, g, or t
  modified_base (714)..(714): a, c, t, g, unknown or other
  misc_feature (714)..(714): n is a, c, g, or t
tcagagtacgctatcacgaccggtgctcgatttagctcgatatagtttgggtctgggagaggacgcccccgccctgggtttcccaggtgttctcatttggtgatcagcactgcanacagaagagtcatcggagggtagtttgggcttgagtcgttgggttttccttgttgtactttaagttttaaggngtccagtggtgnggtgngagcgtaggtggtgtcggtagggggngtcgtttcggaccgngggtccggttacggggtccctggacgtctccgtcgtaggtnacgcgtcttcgtagtacttcctacttgttattacgtttagctactagtacgacgtcggtccgggcctccgagtacccggtaggaaaggggttacgaagtacggtattacgtacgtttaacgacggtaaagtttaagtaaaagtgtaaacgtcggtaacttaaaataaacgttataacttttaagttactaccgtaaacgtacgtttacgaggtacgggtaaacgttacgtactaccgtactaccgttacgaccggtaaggtaaacctaaacgacccgaaagtccgtacgtacttactaccgttaagtacgaacgtgtaacgcggtaccgaggtactacgaggtacgaaccgggtntccgggtattacgtacgtagttcgagggacgtagcggtacgtagttaggtcgtaacgggtggtacgggnggnggtacg

SEQ ID NO: 267770 - DNA, 980 bp, Homo sapiens
  misc_feature: GYAE6OF01E2HT0.28.57.F02.1.454.CMB.1.raw
  modified_base (215)..(215): a, c, t, g, unknown or other
  misc_feature (215)..(215): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttattttaaaggtgtccagtgtgaggtgcagtctggtggagtcgtgggggnggtcgttggtccaggtccgtggggggtcccctggacgcctcctccgtgtgcgacgtccctacgttggtacttcctacccgtttctaacggttaacttttaagtcgtaccttaagtcgacctaccgggttccgggtccccggaccccgtacggggtcccttacccgggaaaggggggaaacggggtaccgttacggggtaaaacttaacgttcggtttaccgttaccggtaaagggtttaacgtttaagggtaaaaacgttaaggtaacggtaaaccggttaaaataaaaccgtaaagttaaatttaaagtttaactaccggtaaccctaaaaaccccgtttggttaacggtacggggtaaaacggtacgtaacgtttaccttacccaaaccccgttacgttacccggtaccccggtaaagggtaaaccctaacgttaaaccgaaaacggaacccgaaagttccgtttaagtaaccgttaccgttaacgtaaacgggtcgggttaaccgaaccggttccggaagtacgggtaaaccgttccgggtaccgggtaaacgggtaccccggtaacgggttaccgtttaaacggtttaaacgttaaaaccggttttaacggggttcggggtaaaagggggggtaacgggtaaagggggttaaacccggggtaaggggttttaaaacggggtttaaccgggggtaaacggggttttaagggggggttaccgggggttaacccggggggtaacccgggtaaacccgggggggg

SEQ ID NO: 267771 - DNA, 624 bp, Homo sapiens
  misc_feature: GYAE6OF01B7IPN.28.57.F02.1.454.CMB.1.raw
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgtggtttctgttgctatttaaggtgtcagtgtgaggtgcagctgggtggagtcgtgggggagcttgggtccaggtccggtcggggggtcctaggagtacctccgtccgtgtgacgacgtccgtgtcggtacttacctaccttgtagtttatttagtgctatcgntacgtcggtcncgacgcgacgagggaacggtnaggtaatgtcgtntacgtaggttataacgaagtangaacaactanatatatatacactactgtgagacggcaagtctacnctagtctaccgaggtaacacgtaacaagacacgtntacgtactccgtaagagtacgactacgacgtacgtagacgtacggtacggacggtacgaacggtctacgttagttaacgtgggtagggtaggtagggacggtaaccggttaggaacgggttacgggtacggtttaaggggtaccgggttccggggtaggaacccggg

SEQ ID NO: 267772 - DNA, 818 bp, Homo sapiens
  misc_feature: GYAE6OF01B0LK5.28.57.F02.1.454.CMB.1.raw
  modified_base (718)..(718): a, c, t, g, unknown or other
  misc_feature (718)..(718): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttattttaaaggtgtccagtgtgaggtgcagctggtggagtcgtgggggaggcgttcggtccagtccggtcggggggtccctggacgtacctccgtccgtggtgcgacgtccttcgtggtacttcctaccctttctagttaatttatcgtacttatcgcctacggttcgggtcccgccgaggtccctaccggaagggggaacgggtaccgtagggtaaattacgttcggttaccgtacgtaagggttaacgtttaaagggtaaaacgttaaagttacggaaaccgtaaaattaaacgtaatttaacgtttaaattaagttacgtaacctaaaccgtttacgttaaggtagggtaaacgggtactaaggttaaccttacccaaccgtactaccgtaaccggaacgggtaaacctaactttaaccgaaaacgtaaccgtacgtaccttagttaaccttaaccgttaacggtaaacgtcgggactacggtaccgtaggtaaccgtgacgttaggaccggtaacgtacggtacgttaagtaacgttaacgtttacgggngggttaaaggggacgggaagggtaaccgggtaagggttaaaggtttacggggaaacggggttttaggggtcggggtaccggggaaccggggtaaccgggg

SEQ ID NO: 267773 - DNA, 741 bp, Homo sapiens
  misc_feature: GYAE6OF01EH4OL.28.57.F02.1.454.CMB.1.raw
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (548)..(548): a, c, t, g, unknown or other
  misc_feature (548)..(548): n is a, c, g, or t
  modified_base (553)..(553): a, c, t, g, unknown or other
  misc_feature (553)..(553): n is a, c, g, or t
tcagagtacgctatcacgaccggtgctcgatttagctcgatatagttgggtctggggagaggagcccccgccctgggtttcccaggttgttctctatttggtgatcagcactgcacacagaagagtcatgacggtagtttgggctgagtcttgggtttttccttgtttgtcttaagtttttaaaggtgtccagttgtgaggtgcagtcgtggtggacgtcggtgggggacgtcgttcgggtccgacggtccggttcggggggtcccctggacgtacctctcctgggtncgagtcctcgtaggtacttctacctttcgtaagttnttttagcgtcttangacctacgttcgggtcccgcgacggtcctaccggaaggggaaggtacgtaggtaattagttcgtacgtcgtaaggttattaaggtaaagttattacgaacgtaaactaaactattaattattagactactaaactcgtggaaggtaacggatacgtacgttcccaacctacgtacgtaaccggaggtaaactaactaaccgaaacgtacncgttntaacgtttctacttaacgaacgttcgggactcggtaccgtagtacgtacgtacggtacggaaggaccgtggttacgtacgtttaagttaccgtttgggtacgggtaaggtaggtaccgggaggttaacggttaacgggtttaacgggtaacgggttgggggtttacggtcccggggaggtacccgggg

SEQ ID NO: 267774 - DNA, 887 bp, Homo sapiens
  misc_feature: GYAE6OF01A1R7V.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgcacacagaagagtcagtgacgggtagtttgggctggagtcttgggtttttccttgttgtctttaagtttttaaaggtcgttcctagtgtggtaggtgcgtagtcgttgggtacggtagttcgggtaggggggaggtccgtttcgggtaccgtacggtcccgggtcggggggttcccctaggacgtaccttccgttccgtggtacgccacggtcctgtaggtacttcctaccgttactaagtttagttttagtcgtacttacgtcggtacccgtacgggttacccggggtcccgaccggtaccggtacccgtaaccggggaacggggggtaaacgggttaaccgttaagggtaaacgtttaacgttagttaccgtaagggtttaaacggtttaaatttaaagggtaaaccgttaaagtaggtaaaaccgtaaaactaaaacgttagttaactttaaagttaaacgtacggtaaacctttaaaaacgggttcggttaacgggtaacgggaaacggtaacgtaacgttaaccttaccgtaaacccgtacgttacccgtaccggtaaaacggtaacctaaaccgttaaccggaaacgtaaccgtaacgttagtaacgttacttaacgtaacgtaacggacggtacgaacgtcggacggtagaccggtgaacgtacggtacaccggtagttacgtagttaaggtaggtggtaacgggaggtacggacggtagttaacggtagggtaacggttaggggttcgggacgggtacggtaccgggg

SEQ ID NO: 267775 - DNA, 565 bp, Homo sapiens
  misc_feature: GYAE6OF01ES4NK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccagggcctacgccgggaagggacgtggaatatgtctcgtaggtattagaagtaatgacgaataacatatattatagcaaactctgtagagggcagattcaccatctacaggaacactcaaagacaacgctgatcttacaaatcgggacagacctggacgtaagcgtaggaggtaccacggtctagttataacttacgttcggtagggaggaagggtagtacgggtaatacgggtaaacgtaggggttggttgggggccctaaggggg

SEQ ID NO: 267776 - DNA, 842 bp, Homo sapiens
  misc_feature: GYAE6OF01EH7EJ.28.57.F02.1.454.CMB.1.raw
  modified_base (52)..(52): a, c, t, g, unknown or other
  misc_feature (52)..(52): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtntgggagaggagcccccgccctgggtttcccaggtgttctcatttggtgatcagcactgcacacaagaagagtcagtgacgggtaggtttgggctggagtcgttgggttttccttggttgtacctttaagttttttaaaagggtcgtaccgtaggttgtaggacggttcgcgagtcgtgggttcggacggttcgggtgggggagtcgttcggtccgacggtccggtcgggggtccctgacggtaccttcgtccgtgtcgcacgttccttagtcgttacttcctaccttacgtagtttactttagtcgtacctatccgtaccgtacggttcgggtcccncggacggtccgtacggaagggtacggtagtaacgtaagttcgtgttacctagtacggttaagtaggaaagttgaacgtaactaaagtaatagttaagttacttaagtcgtaactaaacgttggtaacggtaaggtaaccgtacgtaagtaccttacctacgtaccgtaccgacggtaaacggtaacctaacttaacgaaacgtaacctcgtacgttacgttactaacgttacgtaaggtaccggtcgaccgtaaggtacggaggtacggtaccgttaagggaacccggtacgttaccggtaacgttacgtttaacgggttaaccgtttaacgggggttccggtaagggggtaacggttacggtaacgggggttaaacccgttagggggttttaacccggtaggggtttaacgggggtcggggttaaccccggggtccggggttaaaccggggg

SEQ ID NO: 267777 - DNA, 728 bp, Homo sapiens
  misc_feature: GYAE6OF01APSSQ.28.57.F02.1.454.CMB.1.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
  modified_base (663)..(663): a, c, t, g, unknown or other
  misc_feature (663)..(663): n is a, c, g, or t
  modified_base (673)..(673): a, c, t, g, unknown or other
  misc_feature (673)..(673): n is a, c, g, or t
tcagagtacgctatcacgaccggtgctcgatttagctcgatatagttgggtctgggagaggagcccccgccctgggtttcccaggttgttctctatttggtgatcagcactgcacacagaagagtcatgacggaggtttgggctgaggtcgttgggttttccttgtgtcttagtttttaaaggcgtcagtgtgaggtgacagcgtggtaggtagtcggtggggtgtcgtttcggtccaggtccgtcgggggtaccctggacgcctcgttccngtgacncgtcctgtgtnttccgtacttcgagttattngtctagtcgccgacgtccgggccncgacggtccacgggtagggtaccggtagaggtatagtccgttagtaccggtagttaacgtaagtaagtacgacggttaacaaacgtttaataattataattacggtcgtaaacgaactttccgtaaggtcggaaacggttacaacggttacctaacctaccgtaacccgtacgtacggtaacgtaaccgttaaccgaaaccgttaaacggacccttccggtccttacgtaacgttacgtaacccgtagtacgggaactcaccgggtagaacccgtgttacggaccgacgtacgccggttatacggttattacggtacggtggtaacgggnggtaacgggngaacgggtttacgttaacgggttcggtaagggttacgggcgggttacggacccgg

SEQ ID NO: 267778 - DNA, 684 bp, Homo sapiens
  misc_feature: GYAE6OF01BH9YJ.28.57.F02.1.454.CMB.1.raw
  modified_base (115)..(115): a, c, t, g, unknown or other
  misc_feature (115)..(115): n is a, c, g, or t
  modified_base (121)..(121): a, c, t, g, unknown or other
  misc_feature (121)..(121): n is a, c, g, or t
  modified_base (126)..(126): a, c, t, g, unknown or other
  misc_feature (126)..(126): n is a, c, g, or t
  modified_base (132)..(132): a, c, t, g, unknown or other
  misc_feature (132)..(132): n is a, c, g, or t
  modified_base (244)..(244): a, c, t, g, unknown or other
  misc_feature (244)..(244): n is a, c, g, or t
  modified_base (296)..(296): a, c, t, g, unknown or other
  misc_feature (296)..(296): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
  modified_base (436)..(436): a, c, t, g, unknown or other
  misc_feature (436)..(436): n is a, c, g, or t
  modified_base (546)..(546): a, c, t, g, unknown or other
  misc_feature (546)..(546): n is a, c, g, or t
  modified_base (584)..(584): a, c, t, g, unknown or other
  misc_feature (584)..(584): n is a, c, g, or t
tcagagtacgctatcacgaccggtgctcgatttagctcgatatagttgggtctgggagaggcgcccccgccctgggtttcccaggtgttctcatttggtgatcagcactgcacanagaagngtcancgaggngtttgggctgagcttgggtttcctgtgcttaatttttaaggctcagtgtgaggtgcagctggtggacgtgtgggggagccgttggccaggccgttcggggggccctggaacnctccgtgtgtcgcgctccttggaagtctccacctttgggagttaatttccgngtccttgtgccccnggttcgggggccccaaacngggtttccccacggacgggggaaancgttttggaaccttctgggtcctaaagtaaaggtagttaagaaggtntacccggttaaanaaataccttaattataaccgtnacctaacgtacgtgtaccggaaggagtactagtccttacaccggtactccgaacggtaataaccgtaccgtaacaaacgcgttacgtcttacgttacttaccggtaacgnggtccgatcgtacgtaggccgttaggacggaacggacncggtttgaagttagttagtaggttcccgggaggtaagggaggcccgggtaggtaggttagggttcccggagggttacgggtacgggccggtcggacgggg

SEQ ID NO: 267779 - DNA, 963 bp, Homo sapiens
  misc_feature: GYAE6OF01BTR6U.28.57.F02.1.454.CMB.1.raw
  modified_base (147)..(147): a, c, t, g, unknown or other
  misc_feature (147)..(147): n is a, c, g, or t
tcagagtacgctatcacgaccggtgctcgatttagctcgatatagttgggtctgggagaggagcccccgccctgggtttcccgaggtgttctcatttggtgatcagcactgcacacagaagagtcatggacgggtagtttgggctgnggtcttgggttttccttgttgtacgttagtttttaaaggcgttccgagttgtggtacggtgacgagtcgtgggtggaggtcggtagggggcgtcgttggtccgacggtccgggtcggggtccctaggagtacctccgtaccgtgtcgaccgtacgtcccgttgtacggtacctttacctaaccgtttcgtaaacgttttaagtttagttcggtaccttaggtacccggttaacgtccccgggttacccgggggttccccgaccggtaaaccggggtccgttaacccggggaaaacgggggtaaagggttaaccgttaaggggttaaccttaacgggtttcccgttaaaccggtttacgggtttaaaaggtaggtttaaaacggtaaaggtttaacgaaccggttaaagtaaacgttaaacttaacgttaaacctttaagttacttaaccgaaaacgtttaacccgtgggtaaggttaaacgggtaacgtccgtaaacgttacgtacctacgttaaccggtaccctaacggtaacggaaaccttaccgtaaacgaaacgtaaccgtacggtaccttaagttaaccttacgaaaccggtaggttacccggtacgtaacggtaacgttaacgacggtaaccgtacggttacggaacggttacggtaacgggttaccgttaacggttacggttaaaccggtttaccgggtacgggaaggggttaccggggaaagttccggggtaaacggggttaacgtttaaacgggggacggggtttaagggtacggggtaaccggggttaccgggtaaaccccggggg

SEQ ID NO: 267780 - DNA, 719 bp, Homo sapiens
  misc_feature: GYAE6OF01EHJDP.28.57.F02.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctggtggagtcgtgggggagcgttcggtccaggccggtggggggtcccctggacgtacctctccgtgtgcagcctcgtggtacttcacccttntaagtatttangactagtgctacgtcggtcccacgaggcctaccggaaggggaacggactaggtactagttgtactacgtaaggttacttaaggaaagtaagtgaacgtaaataactaattaattaatacgtagactaaacgtcgtaggtaagaagggtactaaggtactttaacccgaccttaactccggtaacccgggaaaggtaaactaaacccgttaccgaaaaacgtaccctaaccggtccttaaggttaacttccctaaagtaaacgttcggggaactacgtacccggtagacgggtaaactggtacgaagggtacctacgggattagtttactaaggtttaccggtagggtacgggtaagacgggaacgtacggtaaaggtttcgggaaacggttttggggtacgggcgggtaaccgaacggggg

SEQ ID NO: 267781 - DNA, 582 bp, Homo sapiens
  misc_feature: GYAE6OF01BRXA5.28.57.F02.1.454.CMB.1.raw
  modified_base (378)..(378): a, c, t, g, unknown or other
  misc_feature (378)..(378): n is a, c, g, or t
  modified_base (469)..(469): a, c, t, g, unknown or other
  misc_feature (469)..(469): n is a, c, g, or t
  modified_base (485)..(485): a, c, t, g, unknown or other
  misc_feature (485)..(485): n is a, c, g, or t
  modified_base (506)..(506): a, c, t, g, unknown or other
  misc_feature (506)..(506): n is a, c, g, or t
tcagagtacgctatcacgaccggtgctcgatttagctcgatatagttgggtctgggagaggagcccccgccctgggtttcccaggtgttctcatttggcgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctcgtggattccacctttcagttatttatgcttatgctacgtggtcccgccaggcctccgagggaaggctaggaactatgtctcgaggtattagaagtaatgacgaataacattaatattagngacaaacttcgtgtaggaaggtcagtacttcgacctactcgtaccgaacggactaacttaccgaaacgacctacgcttagtactccttaanaagttgggcagctgangtcgtaggaggtacgacggtntagtaatagttacgtggtagggaggtagggacgacgggtaattagggacgttaggggttggtcggggacgtagggg

SEQ ID NO: 267782 - DNA, 847 bp, Homo sapiens
  misc_feature: GYAE6OF01DQN1B.28.57.F02.1.454.CMB.1.raw
  modified_base (122)..(122): a, c, t, g, unknown or other
  misc_feature (122)..(122): n is a, c, g, or t
  modified_base (727)..(727): a, c, t, g, unknown or other
  misc_feature (727)..(727): n is a, c, g, or t
  modified_base (741)..(741): a, c, t, g, unknown or other
  misc_feature (741)..(741): n is a, c, g, or t
  modified_base (838)..(838): a, c, t, g, unknown or other
  misc_feature (838)..(838): n is a, c, g, or t
tcagagtacgctatcacgaccggtgctcgatttagctcgatatagttgggtctgggagaggagcccccgccctgggtttcccaggtgttctcatttggtgatcagcactgcacacaagaagngtcagtgacgggtagtttgggctgagtcgtttgggtttttccttgttgtactttaagttttttaaaggtcgttaccgtaggttggtaggagggttcgcgtaggtcggttggggtgggtacgggttcgggtggggggggtacgtccggtttaccgggtccgtacggggtcccggggttcgggggggttccctgggaaccgtccttccgttcgtggtcgacctacggtccttcgtacggtactttacctaccgtttacgtagtttaatttacgtcgtacttacgtccgcgttaccgggtcccgggtacccgcccggttaccggaccggtacgggtaaacgggggtaacgggtaactacgggtaaacttcggtttgtacgttaacggttaaggtttaaaagttaaacggtaaaggttaagtaccggtaaaacttaaacgttaaactaaaggtttaactttaacttaaacggtacgttaaactaacggtttcggtaacggggttagaacggtaacgtacgttacctaaccgaacgttaccgtaccgtaacgaacggttaacaacgtaaccgacgtacacgttcttaacgtactcgttaagacgtcgganaacgtcggaagtgngtagtaggaccctggaacgtttcgtaattaacggttgttaggacggaggaggtacggtggagttaaccgggtgggttaacgggtagggtcgggcggngtaaccggg

SEQ ID NO: 267783 - DNA, 750 bp, Homo sapiens
  misc_feature: GYAE6OF01DFJJP.28.57.F02.1.454.CMB.1.raw
  modified_base (478)..(478): a, c, t, g, unknown or other
  misc_feature (478)..(478): n is a, c, g, or t
  modified_base (606)..(606): a, c, t, g, unknown or other
  misc_feature (606)..(606): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtaggtttgggctgagtcgttgggttttccttgttgtacttaagttttaaaggtgtcctagtgtggaggtgcgagtcgtgggtggacggttcgggtgggggaggtccgtttcggcccgacgggtccgggttcggggggtccctaggaccgtcgtccgttccgtgtcggactaccgtcctcgtcggtacttcctaccttacgtattttagttagtcgtacttagtcggtccgtacggttccggggtccccgaccggaccggtaccgtaccggaaggggtacggacgtaggtaactgtacgtactagtaagtaagttaagaagtagacgtaagaaactaatattaaatntatacaactatcgtgaagtaggactactactaccactcgtacgtaccggaacgtaaacctaacgaccgtaaagacctcgtaactacttactacgtaaagaggtacacggttacacgaggactaacggnggtaaccggacgtaccggtacgtagttagtaaggttacgtacggggttagggaaggtagggaaacgggtacgggttaaaaccgggtaggttaaaccggggtaggggttaccggggagggggtcccggtaacggggtacccgggg

SEQ ID NO: 267784 - DNA, 786 bp, Homo sapiens
  misc_feature: GYAE6OF01EVBLJ.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgcacacagaagagtcatgacggtagtttgggctggagtcgttgggtttttccttgttgtcttaagtttttaaaggtgtaccagtgtgaggtgcagctgggtggagtcggtgggggacggtcgtttcggtccaggcccggttcgggggggtcccctaggacgtaccttccttccgtgtcgccgagtcccttgttgggactttccctacccttttacgagtttaattttagtgtaccttaagttcgccctacgtttccgggggccctccgaagggtccttaacccgaggggtaacggacgtagggaacttagtcgtcctaggtagttacttagaaattagtcgaacgtaaatacgtaattaacttaagttactaagtaacctaaaacgtcgtaaaggttccgggaaaggctaaacggttactaccaaccgttacttacccgtaaccggtaacggtaaaccttaacgttaacccaaaacgaacccgtaccggtattaccggtttaacttacccgttaaacgtaaacgtcgggtaacacggtaccgtaggaacgtaagtcccgtaggaacgtaccgtacggtactacgtttacgttaagttcggtaggtacggggagacgggtacggtagttaaacgggtggtaacgggtttaggggtttcgcgggggaacgtaccgggg

SEQ ID NO: 267785 - DNA, 756 bp, Homo sapiens
  misc_feature: GYAE6OF01DU4R9.28.57.F02.1.454.CMB.1.raw
  modified_base (223)..(223): a, c, t, g, unknown or other
  misc_feature (223)..(223): n is a, c, g, or t
tcagagtacgctatcacgaccggtgctcgatttagctcgatatagttgggtctgggagaggagcccccgccctgggtttcccaggtgttctctatttggtgatcagcactgcacacaagaagagtcatgacgggtagtttgggctgagcttgggtttttccttgttgcttatttttaaaggctccagtgtgaggtgcagcgtgggtggagttcgtaggggggngtcgttggtcccgaggcccggttcgggggggtacccctgaacgtccttcctccgtgtcggcacgtcccttcgtaggtctttaccctacctttacgtaagtttattttagttctacctagtctccgtaccggttccggggtccccgccggacgtcccgtaccgggaaagggggaacggtacgtaaggtaacttgttcgttctacggttaaggttaacttaaggtaaattacgagtaacgtaaataaactaattaattaattactagaactaacttcggtgtaacggaacggtacaacgtacttacccaacgtacttccgaacgacggtaactaacgtaacaacgaactcgttactcgtactttaccgtaaggtagtacgggactacgtaccgtaagaacgtggtaccgtaagggaccggacggtacgtaacgttgttaaacttaggtacgggttaggaagggtacgaagggacggtagttaaagggttacgggtaaacgggtttggggtcgggtccggggtccggtaaccgggg

SEQ ID NO: 267786 - DNA, 869 bp, Homo sapiens
  misc_feature: GYAE6OF01EN7PR.28.57.F02.1.454.CMB.1.raw
  modified_base (213)..(213): a, c, t, g, unknown or other
  misc_feature (213)..(213): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttcttgttgcttatttttaaaggtgtccagtgtgaggtgcagctggtggagtcgtgggggngcgttggtccagccgtggggggtccctgagctctccgtgtcgcacgcctcgtggtacttcctaccttcagtttatttaagttcgacttagtcggtaccgaccggttcggggtacccccgtccgaacgggcccttaccgggaagggggtaaacggggtccgtttaaaggtaattacggttcgttaccgtagggttaaagtagttaagggtaaaactttaggacggaaacttaaaaactaagtaaagttaaatttaaagtttacgtaaccgtaaacgttaaacccgttggtttaaggggaaagggttaacgggaccgtaagttttaccctaaccctaaacgttacctacccggttaacgggaaacggtaaaaccctttacgaaccgtaaaacgacccgtacgtacggttataccgttaacctaaggtagggtaccaacggtccgtaacggacgtaaggtaaccggttaggtaacgggacgtaacccggaacggtttgttaaacgtttacgtttaaacgttacgggttggggtaaaaggggtaacggggtaacgggtaacgggttaaaacggggttacgggttaaaaacgggggtttaccgggggtttaaacgggggtttccggggggaacccggggtaacgggggtttaacccggggg

SEQ ID NO: 267787 - DNA, 961 bp, Homo sapiens
  misc_feature: GYAE6OF01D32NQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttatttttaaaggtgtcagtgtgaggtgcagctggtggagtcggtgggggacgtcgttcgggtcccaggtcccggttcggggggttcccctggacgacccttccgttccgtgtcgacctacggtccctcgttcggttattccttacccgttcgtagtttaactttttacacggtacttacgttccggaccgttaaccgttccggggtaccccgaccggtaacgggtaccccgtaccggggtaaaagggggtaaccggggtaccgttaacgggtaagttaacgtttcggttacgtaccggtaaaggtttaagttaaacggtaaagttaaacgtaggaaacgtaaacgtaaacttaagtaatttaagttacgtaagtaaccgtaaacgtttcgttaacgggtaacggtaaacgggaccttaaagttaacgtttaccccaaacccgttacgttaccgtaaccgggaaaccggtaaccgttaaacgtttaaacccgaaaccggttaaaccgtacccggttaacgtttacgttaaaccgtttaacccgtaaacgttaaacggtaggggtaaccctagggttacccgttaaaggaccgggttaaaccgccggttaacgggtaaccgggaccgttaaccggttaacgttacggtttaaacgtttaggggttaaacgtttaggggtaaccggggaagggttacccggggaaaggggtaccccgggttaaaagggtttcccggggttaaaacgtttaaccgggggggttcgggtaaaccggggggtaacccgggttaaccgggggg

SEQ ID NO: 267788 - DNA, 555 bp, Homo sapiens
  misc_feature: GYAE6OF01CORLC.28.57.F02.1.454.CMB.1.raw
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (435)..(435): a, c, t, g, unknown or other
  misc_feature (435)..(435): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagccccccgccctggggtttcccaggtgttctctatttggtgatcagcactgcacacagaagagtcatggacggagtttgggctgagcgtgttcgtgtagctatttaagngtcagtgngngtnacagctggngntgnggganctgccngtcgtggggacctgatctctcgtagnacnggtcctgagtacttccacttagattaacttgctctaancgtcnggtcgaccgacgagccncggaggacgatttaggaatnttagntagtagtaagtaagaatccnggtaaataacctatataattgactanaacccttaancgttacgagaganctataccancgttaccagtacccgaattacaacganacccgtntggtattaccagttaagacgtcgaagcgttaacgngatgacgagacgtagcgtattacgtatagtagggacggtagaacgtggtacggaggttgtcggaaggtggtcgggacggagtcgg

SEQ ID NO: 267789 - DNA, 729 bp, Homo sapiens
  misc_feature: GYAE6OF01DSQZI.28.57.F02.1.454.CMB.1.raw
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagctggtggagtcgtgggggacgcgttggtccgagccgtggggggtccctgagactctcctggtgcacggcctctggtacttccaccttcagttaatttatgtactagtcgctacgttcggggtacccgccgacggtccgtaccggaaggggaaacgggaccgttaggaaattacgttcggttacctacggtaggttaaacgttaaggtaaagttaagtacgtaaaccgtaaagttaaacctaagttaatttaagttaatcggtaacaaacggtttcgtaggaggaaacgggtctaacggtaaccttccgaacctacgttaccaccggtaacgggaactaacgttaaccaaacgacccgtacgtcgttaagtacgtttctaacgaaggtcggacacgtacgtagacgngtacgngacgacgtaacgtgttaacgtagttacgtaaggtcggtaggggaagtggggtaaacggcgttaaagggtttaccgggaaacgggtttaggggttcgggacgggggttacccgaaaccgggg

SEQ ID NO: 267790 - DNA, 775 bp, Homo sapiens
  misc_feature: GYAE6OF01CGJPQ.28.57.F02.1.454.CMB.1.raw
  modified_base (599)..(599): a, c, t, g, unknown or other
  misc_feature (599)..(599): n is a, c, g, or t
  modified_base (677)..(677): a, c, t, g, unknown or other
  misc_feature (677)..(677): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcagtgacggtagtttgggctgagtcgttcgggttttccttgttgtactttaagtttttaaacggtgtccgtagttggtgagggttgccgaggtcgtgggtggtacggttcgggtgggggtacggtcgttcggtccgacggtccgggtcggggtccctgacgtcctctcgtgtgcgacgcctgtcgtacttcctacttcgtaatttactttagtctcttagtcgtaccgtcggtccgggttacccgccggtaaccggtccggtaccggaaagggggtaacccggtaggtaagggtaattccgttcgttacccgtaagggttaacggttaatttaaaaggaacgttaaaggtcgtaaacgtaaattaaacgtaatttaaggttacttacgtaacgtaacgtaaacgtttgtaaggtaccggaggtactactactctaacgtactaccgttacggaacgtactaacgtaacacgtaacncgtacttagtaccttataacgttacggacgacgtaacgacgtacgacggtaccgtacgtaggtacgtaccgacggttntaccgttagtacgttaggtagggttggaggtacgggtaaggtacggttaggttaacggggtaccggttagggggtccgggtcggtgggtaacccgggg

SEQ ID NO: 267791 - DNA, 754 bp, Homo sapiens
  misc_feature: GYAE6OF01BAU3K.28.57.F02.1.454.CMB.1.raw
  modified_base (397)..(397): a, c, t, g, unknown or other
  misc_feature (397)..(397): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttattttttaaaggtgtccagtgtgaggtgcagctggtggagtcgtgggggagcgttggtccaggccgtggggggtccctgacgactctccgtgtgcagcctcgtggattccaccgtttctagttacttttatcgacttagtcgtctacggttcgggtcccgccgaaggcctaccggaaggggaacgggacgtagggaattagtcggtctacggaggttaattaagaaggtanagtaacgtaaataactattaattattaatacggaactaactctaggtaggaagggacaagtacgttaccaactactaccgtaccgtaagggtaactaactaaccgaaacgaacgacgtacctagttacttaccttaacgaagtacggacgtacggtacccgtagacggacgtacgacggtaggaacccggacgggtaccgttaaggttaacgtttaacgtttaacgggttacggggttaaggggtaacgggtaaacggggtaacggggtaacggggttaaacgggtttaacggggtaaacgggtttaaaggggggtttacggggggtccggggtaacccggggttaaacccgggggg

SEQ ID NO: 267792 - DNA, 740 bp, Homo sapiens
  misc_feature: GYAE6OF01BX4SP.28.57.F02.1.454.CMB.1.raw
  modified_base (305)..(305): a, c, t, g, unknown or other
  misc_feature (305)..(305): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggattccacctttcagttatttatgctatgctacgtgggtcccncaggcctccgagggaaggactaggatagtgtctacgaggtataggaagtatgacgtaaataacatattactagtagactaaacttcgtaggtagggaacgggctaaggtactttaccgaaccctagttcccgttaacccgaaggggtaaacctaaaccgtttaaccgaaaacggtaacccgtacggtaccgttacgttaacgttaccgtttaaaccgaaaggtttaccggggactaacgggtacccgttagggaacgtacggtaccggttagggaacgggtaacccgaccgggttaccgttaggtttaacgttaacgtttaaccggtggggttacgggggaaaggtaggggaacggtaacggggttaaggtttaaccggggtaaacgggtttagggggtttcggggttaccggggggacccggttaaacgggggg

SEQ ID NO: 267793 - DNA, 794 bp, Homo sapiens
  misc_feature: GYAE6OF01EQ0A2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagcgtgggttttccttgttgcttagttttaaaggtgtccagtgtgaggtgcagcgtggtggagtcgtgggggagtcgttcggtccgaggccggttcggggggtaccctggacgtacctccttcgtcgtgccgacgcccttcgttggacttcccgacctttctacgttaagtttagcgtctaatcgcctacggttcggggtccgccgtacggcctaccgggaaggggaacggtacgtacggtaattagttcgtacttacgtaggttaaacgttaaggaaagttacgtcgtaacgtaaaaacgtaattaaacgttaactttaaagtttacgtacgtaaaaccctaagtttccggtaaaggtacgggtaagggaactagttaaactttaccaacccgtagttacccctacggaacggttaaacctaaaccggttaacaaaacgaactaccggttagttacttattaaccgtacgtaaaggtcggcctaacggtaccaggtagacgttacggaacgggaaccgtagggtacccttggttaaagttacgtttacgttacggtagggggtaggtaacggaaggggttaaccggtagggtaacccggttaaaggttggggtttaagggggttcgaccgggggacggtttaaaccgggg

SEQ ID NO: 267794 - DNA, 875 bp, Homo sapiens
  misc_feature: GYAE6OF01AKYON.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgtactttaatttttaaaggtgtcctaggtgtggaggtgcgtacgcgttggggtgggtaggttccgggtaggggggtacggtccgtttcgggtcccgacgggtcccggggttcggggggggttccccctagggaccgtacccgttccgttcccgtggtcgaccgtacgtcccttcgtaggtcttccgtaccctttctaagtttacttttagtagtaccttagttcgccgtaccggttcgggtccccggccgtacggtccgttaccggaagggggtaacgggtaccgtagggtaacttaggtcgttctacgtaaggttaacgttaaagtaaggttagtacggtaacgaaacttaacgtaatttaaattaacttactaggtaacctaaacgttacgtaggtacgggaacggtacgtaacgtacgtacctaaccctctacccggttaaccgaacggtaactaaccgttaaccaaacgtaaccgtaccgtccttagtaacttcgttaacgtacggtacggtactaccggagtaccggaacgtacggacggtacggaaccggtaccggtacggtacgttagttaactttaaccgggttaggttaacgggtaagggttaacgggaagggtacccgggtaaggggttttaaacgttaacgggggttaacggttacgggggggtttcgggtaacggggggtaacccgggtaaacccggggg

SEQ ID NO: 267795 - DNA, 776 bp, Homo sapiens
  misc_feature: GYAE6OF01CTAO5.28.57.F02.1.454.CMB.1.raw
  modified_base (215)..(215): a, c, t, g, unknown or other
  misc_feature (215)..(215): n is a, c, g, or t
tcagagtacgctatcacgaccggtgctcgatttagctcgatatagttgggtctgggagaggagcccccgcctgggtttcccaggtgttctcattggtgatcagcactgcacacagaagagtcatgacggtagttgggctgagtcgttggtttccttgttgtcttaagttttaaggtcgtcagtgtgaggtgcgagtcgtggtgagtcggtggggngtcgtcggtccgacggtccggttcgggggtccctaggacgtaccttcgtccgtgtcgccgtacgtccgtacgtaggtacttaccgtacgttagtaacgttagttacgtgtcgttagtacgtaccggtacggtccgggtacccgtacggtaccggtccgtaaccgggaaaggggtaacgtacgtacggtaagttcgttcgtacgttaaggtaaggtaacgttaaggtaaacgtacgtacgtaaactaaagtaaactaagttaattaagttacgtacgtaacctaacgtggtaacggtaacggtaacgtactacgtacgtactaccgtacgtaccgtaacggtaacgtaacctaacgtaaccgaacgaaccgtacgtacgtacgttaactacgtaacgtaacgtacggacgtacgtcgtacgtacggtagtacggtaggtaaccggtacgtacggtacgttaggtaacttaggtaggtacgggtagggaacggtaacgggtaggtaacgggttaacgtaagggttaacgggttaggggttacgggtcgggtacgggtaccggg

SEQ ID NO: 267796 - DNA, 735 bp, Homo sapiens
  misc_feature: GYAE6OF01A78AL.28.57.F02.1.454.CMB.1.raw
  modified_base (178)..(178): a, c, t, g, unknown or other
  misc_feature (178)..(178): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaaggngtccagtgtgaggtgcagctggtggagtcgtgggggagcgttggtccagccggtgggggtccctgacgctcctccgtgtgacgacgtcctcgtggacttccaccgttcagttactttagtcgcttagtgacgtacggttcgggtcccgtccgacggcctaccggaagggggaacgggaccgtaggtaacgtttaagttcggttacctacggtaaaggtttaagttaaacggtaaaagttaaagtacggtaaccgtaaaactaaactaaattaagtttaacttaaacgtacgtaactaaacgttaccggtaggttaacgggaaacggtacgtagtaacctttccgaacccgttataccccgtaacgggaaacggtaccttaaacgtaacaaaccgtaaccgacgtactaagttacttactaagaacggtgggtaacacggtaccgtagaaggtcacgtagggaaccgacgtcgtaacgttagttataagttcgtagggtggaaggtacggaagtcgggttaagtacgggtagttagggtccggtagggccggtacggg

SEQ ID NO: 267797 - DNA, 850 bp, Homo sapiens
  misc_feature: GYAE6OF01CJALK.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagtcgtttggggtttttccttggtttgtactttaagttttttaaaagggtcgttaccgaggttggtggtagggtcgcgtaggtcgttgggtagggtaggttcgggtggggggtacgtcggtttcggtacccgacggtccgggttccggggggtccctggacgtaccgtccttccgtggtcgccgacgtccttcgttaggtactttccctacctttacgtaagttttaattttactcggtaccttaagtcggacctaccggtcgggtccccgaccgtacggccgtaccgggaaaggggaacggtcgtaaggtaaacttcggtacgttcgtaacgtaggttaaacgttaaggaacttagtacgtaagtaaaactaacgtaattaagttagttaagacgtaaaccttaacggttgtaggtaacggaacggtctaacgttactaccaccgttactccgtaacggaacgtaactaaccgtaaacgaacgtaccgtaacgtcgttaacgttacttaccttaaggagtcgggactacggtccgaagtacggtaggacggtaacggaacggtaccgtaacgttcgttaacgttaagtttacgttagggtacgggtaaggggaacgggtaaggtacgggttaaagttaacggggtttaaaggggttaacgggtttagggggtccgggggttaaacccgggcggggtaaacccggg

SEQ ID NO: 267798 - DNA, 967 bp, Homo sapiens
  misc_feature: GYAE6OF01APSQ2.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggacgccccccgcccgtgggtttcccaggtgttctcatttggtgatcagcactgcacacagaagagtcatgacggtagtttgggctgagtcgttgggttttccttgttgtcttaagtttttaaaggtgtccagttgtaggaggtgcagtcgtggtggtagtcggtgggggacgtcgttcggtccgacggtccggttcgggggtccctaggacgtacctccgtcgtcgtcgaccgtacgtcctacgtnttacgttaccctacgtttctaagtttatttagtcgtacgttagtcgtcctaccggttcgggtcccgcgaacggtccggtaccggaagggggtaacggtagtacggtaaagttacgttgtaccgtagtaaggttaagttaacgtaaagttacgtaggtaactaaaacgtaatattattaacgttacgtactaaccgtaacgttaggtaggtaacggtaacgggtacttaagttaacccgttaacccgaacttaaccgttaccggtaaacccggtaaacgggttaaacccttaaaaccgtaaccccggtaaaacgtaacccgggttaacccgttccgttttaaaacgtacccgtttttaaagaaaaccccgttaggggttaaccgggttaaacccgaaacgggttttcccccgaaaacggggtaacggttacccggtaacggggtttaaaccggggaaaacccgggttacccggtaaaacccgggtttcgggtttaaaagtttaaacccggtttttaacgggtaaacgggttccggggtaaggggggttaacggtaaaccggggtacccgggggttttaaaggtaaaaccggggtttacgggggtttaaacccggggttagggggttttaaccggggaaccgggggtacccgggggtaaccgg

SEQ ID NO: 267799 - DNA, 1008 bp, Homo sapiens
  misc_feature: GYAE6OF01EYLUH.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcagtgacggtagtttgggctggagtcgttgggtttttccttgttgtactttaagtttttaaacggtgtccgtaggttggtggtaggtcgcgagtcggttgggtgggtaggttcggggtagggggtcggtccggttaccggtaccgaccggggttcccggggttcccgggggttacccgtacggtaccgtacccttccgttccgttcggtacgccgtacgttcccgttacggtacgttaccttacccgttaccgttaacgttaagttttatttagttacgttacgttagtaccggttacccggttaccgggttccccggggtacccgtaccgggtaccgggtacccggttaaccgggggaaacgggggtaacgggttaacggtaacggttaacgtttacgttaccgttaaccggttaacgggtttaaaggtttaaacgggttaaaaggttaaacgtaacggtaaacggtaaaacgttaaacgttaaacgttaaagttaacgtttaaacgttactaaccggtaaacctttaacggtacggttaacgggtaaacggtaccggtaacgtaaccttaacccgtacccgtaacgttaccccttaaccggtaaaccggtaaacgtaaaccttaaaccgtacccgggaaaactaccggtttaaccggtaatttacccgtaaacgtttaacggaacgtacggggtacgtacccgtacgggttacgaacggtacgtccgggtaagacgggtaaccgacccgttaaggtgttaaactttacggtacggttaggggacgggtaagggtaaggtaaccggggttaagtaaacgggttaacggtaacgggggtttacgggtaacgggggttaccggggacggttaccgggtaccgggg

SEQ ID NO: 267800 - DNA, 891 bp, Homo sapiens
  misc_feature: GYAE6OF01CC15P.28.57.F02.1.454.CMB.1.raw
  modified_base (200)..(200): a, c, t, g, unknown or other
  misc_feature (200)..(200): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagtcgttgggttttcttgttgtcttaagtttttaaaggtgtcctagtgtgaggtcgnagtcgtgggtgggtagtcgggtggggggacggtcgtttcgggtacccgtacgggtccggttccggggggggttcccctaggtaccgtacctttccgttcccgttggtcgccgacgtccttacgtcggtactttcccgtaccttacgtaagtttatttaacgtcgtacttaagtcgtccgtaccgtcccgggggttccgaccggtacggtaccgccgggaaaggggtaacgggtaacgttaggtaactacggttcgttaccttacgtaaggttaacgtttaaggtaacgttaaagtagaacgttaaataaacgtaatttaagttaatttaacggtaactaaccgtaacttcggtaaggtacggtaacgggtaccgtaagttaccgttaccgtaaccccgtaaccgttaacccggtaccgggtaaaccgggtaaacctaaaccggttaaccgaaaaccggtaacccgtaaccgtacgtttaaccgtttaacttaccgttaaacgggtaacggttacgggtaccgtaacgggtacctacgggagtacccggttgtacgggacgaaccggtacgttccgttaaggttacgtttaaggttacgggtagggtagggggaagggtaggacgggttaacggtacgggttaacgggttacgggtttaaggggtcggggtaggggtacggggtaaccgggg

SEQ ID NO: 267801 - DNA, 770 bp, Homo sapiens
  misc_feature: GYAE6OF01A9ZP9.28.57.F02.1.454.CMB.1.raw
  modified_base (692)..(692): a, c, t, g, unknown or other
  misc_feature (692)..(692): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttccttgttgtcttatttttaaaggtgtccagtgtgaggtgcagcgtgggtggagtcggtgggggaggtcgttcggtccgaggcccggttggggggtcccctggacgtaccgtcctcccgtgtcgctacgtccgttcgtggtacttacctacctttacgtagtttattttacgtcgtacttagtcgccgtacgttcgggtcccgccgacggccgtaccggaagggggtaacggacgtaggaattagtcgtacgtacggtaacgttaagttaaggtaaagttacgagtaacgtaaataaacgtattaataattacgtacgaacctaaacgtcgttaggtacggaaggtacaagttacttaccaccgtatcccgaacgggtaaacgtaaaccttaaccgtaaccgaaaacgtacccgtaacggttctttacgttaaccttacccggtttaaattaaacgggcggtaacgaccgtacgagggtaactacggttacgacggacggtaaccgtcgtacgtttaattacggttaacgttaggggngtagggggaacgtaaggttacggaacgttaacgggtaggttaacggtagggggttccggacggggtccgtaacggggg

SEQ ID NO: 267802 - DNA, 836 bp, Homo sapiens
  misc_feature: GYAE6OF01DNOE7.28.57.F02.1.454.CMB.1.raw
tcagagtacgctatcacgaccggtgctcgatttagctcgatatagttgggtctgggagaggagcccccgccctgggtttcccaggtgttctctatttggtgatcagtcactcgcaacacacggaagacgtcatgacggtagtttgggactgagtcgttgggttttccttgttcgtattaagtttttaaagggtcgtcctaggttcgtaggtaggtgctaggtcgttgggtcggtaggtcggtacggggggacgttccgttcgggttacccgacggtcccgggttcgggggggttccccttaggaccgtaccgtttcctcccggtggtcgtcctacggtccttcgtggtaacttccctaaacctttcgtaagtttatttaacgtcgtacttagtaccgtcggtaaccggttccggtacccgtacgacggttaccgaccgggtaaaggggacgtaacgtgtaaacgttgttaccgtgttagtaaggtttaattaaggtaaggttactaggaactaaagtaaccttagttaatttacttaaggtacctaactacgtacggttacggaaaggtacggactacgttacgtaaccctaaccggttactccggtaaacgacgtaaaccgtaaacgtaaaccgaacgtaacctaacgttaccgtacgttaattaccgttaacgaacggttagcggtacgtacgtaggtactaggtcgtaacgggtaccgacgtacggttagttactaacgttacggttggtacggggaaggtacggtaagggaacgggttaggtaacgggtacggtaaacggggttgggacggggtacgggtcgggtaaccggg

SEQ ID NO: 267803 - DNA, 815 bp, Homo sapiens
  misc_feature: GYAE6OF01DEWAJ.28.57.F02.1.454.CMB.1.raw
  modified_base (707)..(707): a, c, t, g, unknown or other
  misc_feature (707)..(707): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttcggttttccttgttgtctttaagtttttaaacgggtcgttaccgtaggtgttaggaggtgacgtagtcgttggtgggagtccggtgggggtacgtcgttcggtccgacggtccggtacgggggttccctaggacgtaccttccgtcgtggtcgccacgtccttcgtaggtaaccttcctaacccgttacgtaagttttaacgttttacgtagtccgttagtccggtacgtaccggttaccgggtccccgaccggtaaccggtccgtaaaccggtaggggtaaacggtaacggtaggtaaacttcgtacgttacgtaacgtaaggttaattaaggtaagtaagtacggaacgtaaaataacgtaagttaactttaacgtatacgtaacgtaaacgttcgtaggtaacggaacggtaacttacggtaaactcccaacccgttacgttccgtaacccgaaacggttaaaccttaacgaaacgtaaccggtaacctcggttcgtttaagtactttaacccgtaagaacggttccgggatacgtacggaagtaacggtcgtnaaccgggtaatccgagggttaacttacgtaattcggtacgtagggacggttaaggacggtaggtaggttacgggtacgtaagggttgggtacggccgggtcgaacggg

SEQ ID NO: 267804 - DNA, 914 bp, Homo sapiens
  misc_feature: GYAE6OF01A8M5R.28.57.F02.1.454.CMB.1.raw
  modified_base (599)..(599): a, c, t, g, unknown or other
  misc_feature (599)..(599): n is a, c, g, or t
tcagagtacgctatcacgaccggtgctcgatttagctcgatatagttgggtctgggagaggagcccccgcccttgggtttcccaggtgttctctatttggtgatcagcactgcacacagaagagtcatgacggtagtttgggctggagtcgttgggttttccttgttgtctttaagtttttaaaggtcgtaccgtaggtggtaggagggtgcgagtcggttgggtggtacggttcgggtggggggacggttcgttcgggtccgtacggtcccgggttacggggggtccctaggtacgtaccgttccgttccgtggttcgacgtacgtccgttacgtgttaccttaccttacctttacgttaagtttagtttaactcgtaccgttaagtccggtaccgtaccggttccgggtacccgtccggacgggtaccgtaccgggaagggggaacggtacgtacggtaattcgtcgttaccgtaggttaaggttaagttaaggaaaggttacgtacgtaacgtaaacttaacgtaatttacgtaagtttactaacggtacttaaacgtacggtaaggtaacggtaacggtacgtaacgtttaaccnccgtaacgtacgtacccggtaacgggtaaacgtaaccgttaaacgtaaaccgaaacgtaaccgtcgtttgttaaccgtttaacgtttaacccgttaaggtaaccggggtaccgaacggttaacgtaccggtaggtaaaccggtgggttaaccgaacggggacgtttaccggtaacgggtttacttaaaggtttacggtttaaccgggttaggtccgggggtaaaggtacggggtaacggttaacgggtaagggttaacggttaacggggtttaacgggtgggggtaaccggggtccgggttacgggaacccgggg

SEQ ID NO: 267805 - DNA, 705 bp, Homo sapiens
  misc_feature: GYAE6OF01CBM3A.28.57.F02.1.454.CMB.1.raw
  modified_base (419)..(419): a, c, t, g, unknown or other
  misc_feature (419)..(419): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttaatttttaaaggtgtccagtgtgaggtgcagcgtgggtggagtcggtgggggaggtcgttcggtccaggtcccggttcggggggtccctaggacgtacctccgtccgttggtcgcgacgtcctcgtggtattcctacctttcgaagttactttatagtctagtcgctacggtcggccgcgaggcctcggaaggggaaggctagaatagtgtctgtagttataagtaagtatgaacgaataactatatattatnaactaatcgtgtaggaacgtatactattcaccacgttccaacggtaaggaaacctaagtaaaccgaaccgaacctacggtacgttaactaacttcctaaacgtaaggtccggaactacgaccgtaaggagtacgacggttcggaacgaccgacgtactaacgtttaagtacgttaggtacggggtaggggaacggtacggggtagggtaaacccgggttttaggtaaacgggggtttaggttaaccgggggttaggggtaacccgggggcgggttaaacccggggg

SEQ ID NO: 267806 - DNA, 736 bp, Homo sapiens
  misc_feature: GYAE6OF01A538D.28.57.F02.1.454.CMB.1.raw
  modified_base (288)..(288): a, c, t, g, unknown or other
  misc_feature (288)..(288): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctggagactctcctggtgcgacgcctcgtggtattcaccttctagtatttangtctagtcgcacgttcggggtcccgccgaggcccttaccggaaggggaacgggtactagggaacttagtggtactacgtaaggttaatttaaggaaagttaagtacgacgtaaaacttaaactagttaatttaagtttaagtagaaccttaaaaccgttcgtaggtagggaacggggactaacggtacttaccgtaacctacgtccgtaccgaaacgggtaactaacgttaccgaaacgtaaccgacgtacctagttacttccgttaactaaaggtcggacacgaccgtagacggtacgtcgtaggacggaccgtacggtcgttacggttaataacggtttaccgtggggtaacgggttaggggaacgggtacggtaacgggttaaggttaacgggttaacggggttaagggggtttcgggtcccgggggtaaccgggtaaccggggg

SEQ ID NO: 267807 - DNA, 756 bp, Homo sapiens
  misc_feature: GYAE6OF01AV5NX.28.57.F02.1.454.CMB.1.raw
tcagagtacgctatcacgaccggtgctcgatttagctcgatatagttgggtctgggagaggagcccccgccctgggtttcccaggtgttctcatttggtgtatcagcactgcacacagaagagtcatgacggtagtttgggctgagtcgttgggttttccttgttgtacttaagttttaaaggtcgtccaggtgttagaggtgactgtcgtagggtgcggtcggtagggggtgtccgttggtaccgtaggtcccggtcgggggttccaggtacgaccttccgtctcggtagtctaccgtccttacggtacgtacttcctaccttacgtacgtttattagtcgtactatacgcgtacggtcggcctacgacgtccgtacggagggtacggtctagtaactcgtgtctacgtagtactaggtaagtagcgtaagtaaagtatagttataagtacgacgtaactaacctgtaggtaagtagtacgtacgttataccaaacgtctaccggtagaaaccggttactaaacggtacaaacgtacgtaacggttcttacgtaacttctaacggtacgttaccggacgtactaacgggttagaccgtaacggtttacgaagggtaccgtaaccggttacctaggttaagttaaccgttaaggtttacccggagggttaagggccggttaaaaggggtcgtaaaacgggttaccgggttaaggacgggttttacggggaacgcggggggtaaaccggttcccggg

SEQ ID NO: 267808 - DNA, 796 bp, Homo sapiens
  misc_feature: GYAE6OF01DSKZT.28.57.F02.1.454.CMB.1.raw
  modified_base (179)..(179): a, c, t, g, unknown or other
  misc_feature (179)..(179): n is a, c, g, or t
  modified_base (340)..(340): a, c, t, g, unknown or other
  misc_feature (340)..(340): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtntccagtgtgaggtgcagctggtggagtcgtgggggaggtcgttggtccgagtccggtggggggtccctggacgtacctctccgtgtcgcgacgtcctcgtggtacttcctaacctttacgtagttaactttagtgtcctaatcgactacgttcggggcccnccgacggtccgtaccggaaggggaacggtaccgttaggaattacgttcgtacgtacgtaggttaagttaagaaacgtaagtacggtaacgtaaacttaaacgtaattaactttaagttagtagtaacctaaactcgttaggtaacggaacgggtactaagtaacgttaccaccgtaacgttacccgtacggtaaacggtaaccttaacgttaaaccgaaacgtaaccgtaccgtaccgttaacgttacgttaccgtttaaacgtaacggttaccggacgtacgtaccggtagaacggtacgtcggtaacggtaaccggtacgggtaccgttacggttacgttaacgttaacgttacggtacgggttaaggggtaggaacgggtaacggggcggttaaacgggttacgggttaaagggttggggtttaggggtacccggggtacgggtaaccggggg

SEQ ID NO: 267809 - DNA, 934 bp, Homo sapiens
  misc_feature: GYAE6OF01D5NHK.28.57.F02.1.454.CMB.1.raw
  modified_base (813)..(813): a, c, t, g, unknown or other
  misc_feature (813)..(813): n is a, c, g, or t
  modified_base (829)..(829): a, c, t, g, unknown or other
  misc_feature (829)..(829): n is a, c, g, or t
  modified_base (869)..(869): a, c, t, g, unknown or other
  misc_feature (869)..(869): n is a, c, g, or t
tcagagtacgctatcacgaccggtgctcgatttagctcgatatagttgggtctggggagaggacgccccccgcccttgggtttcccaggttgttctctatttggtgatcagcactgcacacaagaagagtcatgacgggtagtttgggctggtagtcgtttgggtttttcctttgttagtacgttttaagtttttaaaagggtcgttaccgtaaggttggttaggtacggttaggaccgtagggtcggtttaagggggtgggtaacgggttccggggtttaggggggggaacggttccggttttccggggtacccgtaacgggttcccccgggggtttacggggggggtcccccttagggaaccgggttacccttcccgttccggttcggtacggaccttaccggtcccttccgggttaaggttacctttaccttaacccgtttaacggtttaatttagtttttaacgtacggttatttacggtagggtacctaccgggttcccggggtacccaccgggtaccggaccggttaccggggaacggggtaaacggggtacgtaaggtaaacgttagttcgttacggtaacgtaaggtttaaattaaagtaaggtaatacggtaaacgtaaaataagtatttaagtaatttacgtaccgtaaagttaacctggttaaacgggtaacgggtaaagggtacctaaacggtcttaaccctaaccgtaccgtaaccggtaacgtaaacggtaaacgttaaccttaaacgaaacaaccgggtaactactaacgttactaacgttaaacgagtagaccggtntaccggtgaagtacgngtaacggtacgcgtaacgtgtaaacttagttaggttacgnggtaagaggaacggtagaagggttagtacgggttaggtaggggttaggaggggtaaccgcggggg

SEQ ID NO: 267810 - DNA, 809 bp, Homo sapiens
  misc_feature: GYAE6OF01BYGMJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttggctgagcgttggttttccttgttagtcttaagttttaaaggtgttccgagtgtgaggtgcgagtcgtaggtggacgtcggtggggagtcgttggtaccgacgtccggttcggggtccctggacgtaccttccgtcgtgtgcgacgtccgtcgtaggtacttccaccgtttacgagttatttagtgtacttagtcacgtaccgtcgggtcccacgtacggtaccgttcgggaacggggtaaacgtaccggtttaggaaacgttacgttaccgttacgtaacgttaggtaaacgtttaaggtaacgtaaacgtcggtaaagtaaacctaaagtaagtttataaacggttacgttaacggtaacctaacggtttaacgttcggtaaacgggtaagggccttaaagttaccgttaaccgtaccgtaacgttacccgtaaacggtaaaccggtaacctaaacgttaaccgaaaaccggtaacctactttacgtaagtttaacgtaccgttaacgaaggttccgacgtaaccgtagtaacggacgtacgacggtaacgggtacgacgtcggttactacgtttaagtaacggttcggtaggtaagggcgaaggggtacggttaaacggacgtacgggttaacgggttcgggtacggggtacgggtccggtaaccgggg

SEQ ID NO: 267811 - DNA, 841 bp, Homo sapiens
  misc_feature: GYAE6OF01CAJ9F.28.57.F02.1.454.CMB.1.raw
  modified_base (213)..(213): a, c, t, g, unknown or other
  misc_feature (213)..(213): n is a, c, g, or t
  modified_base (276)..(276): a, c, t, g, unknown or other
  misc_feature (276)..(276): n is a, c, g, or t
  modified_base (594)..(594): a, c, t, g, unknown or other
  misc_feature (594)..(594): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagtcgtgggttttccttgttgtcttaatttttaaaggtgttccagtgtgaggtgcagcgtggtggtagtcgnggggagtcgttggtaccaggtccgttcgggggtccctagacgtaccttcctccgtgtacgtcncggccttgtcggtattccgtaccctttcgtaagtttaatttacgttacgtccgttaagtcgtacctacggttcgggttccccgaccggtacggtaccccgttacgggaaacggggtaacgggtaaccgttagggtaacttaacgttcgttaccgttacgtaacggttaagttaacggtaagtaagtacgaaacggtaaactaacgtaattaagttaagttacgtacgtaacctaaccgttgtaggaacggtacggtacagttaccttacgaccttacgtaccgtagaacggtaaccttaacgtaaccgaaacgaaccnccgtattacggttaccttacgtaaacgtaacgtacggactacggtctaacgggtagccgtaacgttggaaccggtaccgttaaccgggttacgttaacccggtttaaagttaacccggttacggggtaagggtaagggggttaaacggtaaaccgggttacggggttaaacgttaaacggggtttaaccggtaaaacggggttttcggggtaaaccgggggtccgggtacccgggtaaacccggggg

SEQ ID NO: 267812 - DNA, 783 bp, Homo sapiens
  misc_feature: GYAE6OF01AZPZ1.28.57.F02.1.454.CMB.1.raw
  modified_base (179)..(179): a, c, t, g, unknown or other
  misc_feature (179)..(179): n is a, c, g, or t
  modified_base (772)..(772): a, c, t, g, unknown or other
  misc_feature (772)..(772): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcttgggttttccttgttgcttaagtttttaaggngtccagtgtggaggtgcgagcgtgggtggtaggtcggtgggggtagtcgttcggtccaggtccggtcggggggtccctggactacgttccgtccgtggtcgaccgtagtccgttcgtggtacctttaccgtacccgtttcgtaagtttacttttactacggtacttaacgtcggaccttaccgggttccgggtaccccggtaccgtacgggtcccgttaacccggggaaagggggtaaccggggtacgtagggtaaactttacgtcgttaccgttagttaacggtaagtttaaggtaaacgtagtaggtaaccgtaaataactagttaaattattaacgcgtaacttaaccgttcggttagggtaacggaagggtcgtaactccttaacccgacctacgtaccgtaacggacgtaaaccttacctaaacgaaccgtaacgtcgtctagttacttcgtaaagacggtgtacgacgtccgaggtagccgaaggtacggaccgtacgacggtttcgaagtttacctaggttcggaaggtagggcggtaaaggtccgaagttaacggtagggttacgggttacgggtgggtccgggnggtaacccggg

SEQ ID NO: 267813 - DNA, 788 bp, Homo sapiens
  misc_feature: GYAE6OF01B2QZ2.28.57.F02.1.454.CMB.1.raw
tcagagtacgctatcacgaccggtgctcgatttagctcgatatagttgggtctgggagaggacgccccccgccctgggtttcccaggtgttctcatttggtgatcagcacctgacacacagagacgtcatgacgggtagtttgggctgagtcttgggttttccttgttgcttattttaaaggtcgtctagtgtaggaggtgtgagtggtggagtcggtggggcgtcgtcggtccgaggtccggttgggggtccctgacgtcgtactccgtgtcgaccgacgcctcgtaggtaccttctaccttacgtaagttacgtttacagtactacgtacgtacggtaccgtccggtacccgtaccgaggtccccggttaaccggaggggtaacgggtacgtaggtaaccttgtaccggtacttagtaacggttaagtaagtaagtaagtacgaaagtaaacgaaattaagttaattaacgttagtaactaacgtaaaccgttctacggaggtaaacggaactagtacccttaaccgaccttagtaaccgttacccgaagggtaacccttaaacttaccgaaaacgtaacccgtacgtacccttaagttacttacgttaacccgaaggttaccgacgtacccgtgtaaggaacggtaccgtaacggtacggacgaacggttaccgagtttacggttaacttaacgggttacctggggaaaggtgggaaacgggtacggtaggttaacctaacgggggttgttacggggttaagggtcgggaccggagggtacccgg

SEQ ID NO: 267814 - DNA, 797 bp, Homo sapiens
  misc_feature: GYAE6OF01C8N5O.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagtctgggtggagtcgtgggggagtcgttggtccaggtccggtcgggggggtcccctaggaacgtcctttccgtccgttgtacggccacggtcccttcgtagggtactttcccaacctttcgaagttttattttagtgtacttaagtcgtacctacggttcgggtccgaccgacggtccgtaccggaaggggggtaacggtacgtacggtaaagtttcgtacggtttccgtaacgtaaggtttaaagtttaagggaaaagtttaacgtcggtaaacgtaaataaactaagtttaattaaatttacgacgtaaactaaaccgttgttagtgggaaacggtcaagtacttaccgacttactctacggaaggtacaacttacgaaacgtacacgtcgtattactcttaacgaaacggttgaccgtaacgtccgtaggtacgtgtacgtaacggggaacgtacggacgggttccttaaggttaaccgtttaggttacgggtcggggtaagggggtaaccggtacggggtacgggttaaacggttaacggggttacgggtttaaacgggggtttgggtaaacgggggtcggtaaacgggggtaacccgg

SEQ ID NO: 267815 - DNA, 705 bp, Homo sapiens
  misc_feature: GYAE6OF01D8GHV.28.57.F02.1.454.CMB.1.raw
  modified_base (331)..(331): a, c, t, g, unknown or other
  misc_feature (331)..(331): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctgtggagtctgggggagcttggtccagcctggggggtccctgagagtctcctagtgcagcctctggattcgaccttcagtatttatgctaatgcactgggtccgccaggctccgagggaaggactaggatatgtcnaggtataggaagtaatagcgaataaacagttataattatgacaaacgtctagtcgaaagggtcaagacttcgaacctacgtactccgaagggtacaaactttccgaaagaaaccgtacgtactaaggtacgtttacttaccgtaaagtgggaaccgagtacccgtggtaacggtataccgttggaaccggggtataacccggggtcgttaaccgggtttaattaaagggtttaacccttacgggggtttaaggggtaaggtaaaacccgggggaggggttaaaccccggtaaaaggttttaacggggttaaaccccgttaaaggggggttttaacggtttaacgggggggggccccgttaaaacccgggggggg

SEQ ID NO: 267816 - DNA, 845 bp, Homo sapiens
  misc_feature: GYAE6OF01E4A8Y.28.57.F02.1.454.CMB.1.raw
  modified_base (727)..(727): a, c, t, g, unknown or other
  misc_feature (727)..(727): n is a, c, g, or t
tcagagtacgctatcacgaccggtgctcgatttagctcgatatagttgggtctgggagaggagcccccgccctgggtttcccaggtgttctcatttggtgatcagtcactcgcacacagaagacgtcagttggacggtgtttgggctggtacgtcgttttcgggttttaccttggttcgtcttttaaagttttaaggtcgttcctaggtggttggtaggtcgacgtagtcggttgggtacggtacggttccggggttgggggacggttccggtttaccgggtacccgtaccgggtccgggggttccgggggtccctacgacgggttacctccgttccgttgtcgtaccgtacgttccgtgtacgttaccttccgtaacctttggtaacgtttatttacgatcgtagtacgtaccggttacggtccggtccttacccggaggtcccgtaacccgggtaaggggtaacggtccggttaaacggtacggttattacccggttaccgtttaggtaacggtttacttaaaacgggtactttacggaaaccgtaaacccgttaaagttaaccggttagtttaacccggtttaaacgttccgttaaaccggaaccgtttaccctacgggtttaacggaacggtccgggttaacacgttacccgtactaccgtacgtaccgtacggaaccgtaacttaacccgtaagaccgtagtcgtagtaccttataccgtanacgtcgacgtcgacgagaccgtgtacggagtaccgagtccgtaggtacgttacgtagtcgtaggacggtaggacggtacgtcgttaagtacggttacgaggtggcggtcggtaaccgg

SEQ ID NO: 267817 - DNA, 815 bp, Homo sapiens
  misc_feature: GYAE6OF01A9KYO.28.57.F02.1.454.CMB.1.raw
  modified_base (192)..(192): a, c, t, g, unknown or other
  misc_feature (192)..(192): n is a, c, g, or t
  modified_base (228)..(228): a, c, t, g, unknown or other
  misc_feature (228)..(228): n is a, c, g, or t
  modified_base (341)..(341): a, c, t, g, unknown or other
  misc_feature (341)..(341): n is a, c, g, or t
  modified_base (377)..(377): a, c, t, g, unknown or other
  misc_feature (377)..(377): n is a, c, g, or t
  modified_base (634)..(634): a, c, t, g, unknown or other
  misc_feature (634)..(634): n is a, c, g, or t
  modified_base (742)..(742): a, c, t, g, unknown or other
  misc_feature (742)..(742): n is a, c, g, or t
tcagagtacgctatcacgaccggtgctcgatttagctcgatatagttgggtctgggagaggacgcccccgccctgggtttcccaggtgttctctatttggtgatcagcactgcacacagaagagtcatgacggtagtttgggctgagtcgttgggtttccttgtgtcttaagttttaacggtgtccgagtgngtaggtgcgagtcgtgggtagtagtcggtagggggngtcgttcgggcccaggcccggttcgggggtaccctaggacgccgttccgtccgtggtcgcgtaccgccttcggtaggttaccttaccgtaccttacgtaagtttaccgtttancgtactagtcgtaccgttaccggttccgggtacccnccgtaggaccgttacccggaaaggggtaacgtacgtaaggtaaatacgttaccgttcgtacgttaaaggttaagttaaaggtaaaattaacggtaacgaacgttaaaataacgtaattaaagtttaacttacgtaagtaacccgtaaagtcgtttagaagggagggtaactagtacctactacctacgtaccgtacgaacgaactaccgtaaacaacggtaacctcgtaacgtttaacgaacgtttaccgaagttanacgggtactaccggtagttaacggaaccgtgtaacccgggtggtaacccgggtaccgtacggtacgtagttaacgttaacggttacgggtagggtacggggtaaacgngggtaaaccgtaggttaaacgggtaaggtaacggggttaaccggtggggtaaacccggtcggggtaaaccggg

SEQ ID NO: 267818 - DNA, 817 bp, Homo sapiens
  misc_feature: GYAE6OF01ARZJ0.28.57.F02.1.454.CMB.1.raw
  modified_base (208)..(208): a, c, t, g, unknown or other
  misc_feature (208)..(208): n is a, c, g, or t
  modified_base (284)..(284): a, c, t, g, unknown or other
  misc_feature (284)..(284): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgtcttatttttaaaggtgtccagtgtgaggtgcagctggtggagtcgngggggaggtcgttggccagccgtggggggtccctgagactctccgtgtcgcacgtcctcgtggtacttccaccttntagttatttatgtctagtcgctaccgtcgggtcccgccgacggtcctaccggaaggggaacgggtacgtaggtaatacgttacgtactacgtaaggttaagttaaggaaacggttaatacggtaaacgtaaaacgttaaactaagttaaacttaattaacgtacgtaaaccgtaaaaccttcggttaggtaacggtaaacgggtaccgaagttaaccttacccgtaaccctacgttacccgaaccgggttaaacgggaaaccttaaacccggttaaacaaaaccggaacccgttacgtaccgtaagtttaccctaacccgttaagtaaacgttcccgggaagtaaccggtaccgtaaggtaaccggtacggtacctaaccgggtacggtaaccgaccggttacgttacggttaaacttaccggtttacggtggggttaaccgggaaaggtaggggtacgggaacggttaaacggttaccgggttaaacggggttaagggggtttcgggtacggggggacccgggttaaccggg

SEQ ID NO: 267819 - DNA, 755 bp, Homo sapiens
  misc_feature: GYAE6OF01CQ7CB.28.57.F02.1.454.CMB.1.raw
  modified_base (343)..(343): a, c, t, g, unknown or other
  misc_feature (343)..(343): n is a, c, g, or t
tcagagtacgctatcacgaccggtgctcgatttagctcgatatagttgggtctgggagaggagccccccgccctgggtttccccaggtgttctcatttggtgatcagcactgcacacagaagagtcatgacggtagttgggctgagcgttgggtttttccttgttgtactttaagtttttaaaggtcgtcctagtggtggaggtgctagcgtgggtgggtaggttcggtggggggacggtcgttcggtcccgaggtcccgggtcggggggtcccttaggaccgtactccgtcctggtcgcgaccgtctcgtagtacttccctaccgttactagtttatttagnttctagtcgtaccgtcggttcgggccccgtaccgacgggccccgtacggaaagggggtaacggtacctaagggtaatttcgttcgtaccgtagtaaaggtaagtaaggtaaacgttagtgaaaccgttaaataaactattaaactagttagacgtaacacgttcgtaagtacgggaactacacgttaacactaccgttacgccttaacccgggaaacgtacttaaaccgtaacgaaacgtaccgaaccgtttactaacgttaactacttaaacgtaaggtaccggtagtccgagttacggacgtcgaccgtggacggactcgtagtacttaagtcgtaggtagggaggagggtaagtccggaaggttaccgtaagggtcgggttaagggtcgggacgggtcgggtaaccggg

SEQ ID NO: 267820 - DNA, 766 bp, Homo sapiens
  misc_feature: GYAE6OF01A72XX.28.57.F02.1.454.CMB.1.raw
  modified_base (443)..(443): a, c, t, g, unknown or other
  misc_feature (443)..(443): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgtcttaatttttaaaggtgtccagtgtgaggtgcagctggtggagtcgtgggggagcttggtcacgtccgtgggggtccctgagactctcctgtcgcacgcctcgtggtacttccacctttctagttactttagtgtctatgctacgtccggtccgccgacggtccgtccgggaaagggtaacgggtaccgtaggtaaattcgttacgtccgttacgtaaggtttaattaagggaaaagttagtacgtaacgtaaaactaactaatttaaattagtttaanacggtaactaaaccgttgtacggtaggaacgggtacgtaacgtacgttaacccgaacctacttaccccgtacggaaacggtaaaccgtaacttaacccgtaaaacgaacccgtaaccggtaacttacgttaaccgttaccgtttaaacgtaacggtacgggactaaccgaccgttaggaacgtacgacgttacggaacggtaccgtaacggtcgttaacggttaacttaacggttacggtacgggtaggggacggtaggggaacggttaggttaagtaaccggttagggttaaggggttcggtcgggggtaccgtaaccgggg

SEQ ID NO: 267821 - DNA, 698 bp, Homo sapiens
  misc_feature: GYAE6OF01DZO0J.28.57.F02.1.454.CMB.1.raw
  modified_base (193)..(193): a, c, t, g, unknown or other
  misc_feature (193)..(193): n is a, c, g, or t
  modified_base (282)..(282): a, c, t, g, unknown or other
  misc_feature (282)..(282): n is a, c, g, or t
  modified_base (614)..(614): a, c, t, g, unknown or other
  misc_feature (614)..(614): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtccagtgtgaggtncagctggtggagtcgtgggggagcgttcggtccagccgtgggggtccctgagctctcctgtgcacgcctcgtggtattccgtacccttnagttactttagtgtacttatcgactaccggtcgggtcccgccgacggccttaccgggaaggggaacggtacgtaggtaattagtcgtactcgtaaggttataagtaaagtataggacgtaaataacattaattacttatcgaactaacgttcgtaggtagaacccggtatagtacttaccacccgtataccgtaccgaacggtaacctaacttaacccgaaacgtaccctaacgtcttaagtacttaccgtttaacgaaggtcgggacaccgtaccgtagtacggtacgtacggtacgacggtacgtcgtacgttagttactagtttacggngggttaggggaaggtcgggaaggtacggttaacgttaagggttacggggttagggtttacgggggccggtaccggggtaccggg

SEQ ID NO: 267822 - DNA, 814 bp, Homo sapiens
  misc_feature: GYAE6OF01CDURG.28.57.F02.1.454.CMB.1.raw
  modified_base (292)..(292): a, c, t, g, unknown or other
  misc_feature (292)..(292): n is a, c, g, or t
  modified_base (320)..(320): a, c, t, g, unknown or other
  misc_feature (320)..(320): n is a, c, g, or t
  modified_base (481)..(481): a, c, t, g, unknown or other
  misc_feature (481)..(481): n is a, c, g, or t
  modified_base (799)..(799): a, c, t, g, unknown or other
  misc_feature (799)..(799): n is a, c, g, or t
tcagagtacgctatcacgaccggtgctcgatttagctcgatatagttgggtctgggagaggagcccccgccctgggtttcccaggtgttctctatttggtgatcagcactgcacacagaagatcatgaggtagtttgggctgagcgttgggttttccttcgttgtcttaagttttaaaacggtgtcctagtgtggaggtgtcaggtgttgggtggtacgtcggtgggggtagtcgttcggtcctacggtcccggtcggggggtaccctggtaacggtcctcctccgtagtcncgacgcctcgtacggtattacctccttnacgttacttagtctactacgtcgacttacgtcgggtacccgccgtaacggtcccgtaccgggtaaagggggaaaccggtcggttaacggtaacgttagttcggtaccgttacgtaaggttaaattaacggttaaagtacgtacggtaacgaaacgtttaanaacttatttacttacgtacgaaacttaacccgtcgttaggtacggtaacgggtcttaaggtacttaccctaacgtaccgttaccgtaccggtacggtaaacctaacgtaaccgtaaacgacgtactaccgtaccttacgtaccgtaagtaaccggtacgcgtaccggtatacccggagtccgacgtaacgggtacggtacgacggtcgttacgttacttaggttacccggtaggtacgggtaaggtcccgtaaaggggtaccggttaaaccgggttagggttaacccggggttaagggtttcggggtaaacccggggnggggttaaccccggg

SEQ ID NO: 267823 - DNA, 826 bp, Homo sapiens
  misc_feature: GYAE6OF01EY6E7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagccgtggggggtccctgacgactctcctgtgcagccttgtggtattccgtaccttctagtattttatgctatagccgtacgtcggggtcccgaccggaaggtccgtacccggaagggggtaaacggggtaccgtagggtaaacgttaacgttcggttaccgttacgtaagggttaagtttaaggtaaagttaaagtacgtaaccggtaaataaacctaaagtttaatttaacgtttaacgtagtaacttaaaaccttcgttacggtaaagggtaaacggggactaacggttaacctaacgttaaccgtactaccgtaacccgggtaacggaaaccttaaacgttaacccgaaaacgggtaccctaaaccggttccgttaaggttaactttaacctacggtaaaaccggttcgggaacctaccggttactaaacgggtacgtaacggtaccggtttaaacgggaacggtaacccggaacggtttaccgttagttaaacgttacgtttacgggtacgggttaggggaaagggtgggtaacgggtacggtaaaggttaccggggtaaagttagggggtttcgggtaaggggacccggtacggggg

SEQ ID NO: 267824 - DNA, 829 bp, Homo sapiens
  misc_feature: GYAE6OF01EURNK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttatttttaaaggtgtccagtgtgaggtgcagcgtgggtggagtcggtggggggaggtcgttcggtcccaggtcccggttcgggggggttaccccctggacgtacccttccgttcccgtggtcggcgacgtcccgttcgttacggtacttccctaaccctttccgtaaggtttaatttttacgtcggtactttacgtcgtaccgtaccggttccggggttccccgccggaccggtccgtaccgggaagggggaaccgggtacgtaaggtaacgtagttcgttacgtaacgtaaggttaagttaaaggtaaagtaagtacggaacgtaaataacctaattaattaattagtacaactaactgtagtaggaaaggctaacgtaactaccctaaccgtacgtcccgtaacgtaaagggtaaacctaaccgttaaaccgaaacgaaccgtacgtacgtttacttaacgtttactaacgtaaggtcggaacgtacgtccgtaaggagaacgttcggaaggaccgggtactacgggtaccgttgttaaacgttaacgtttccgggagggttggggaaaacggttcgggaaacgggtaacggttaacgggttaaggggtaaacggggtttaggggttcgggggtaccggggaacggggttaaaccccggggg

SEQ ID NO: 267825 - DNA, 931 bp, Homo sapiens
  misc_feature: GYAE6OF01BQ5Y1.28.57.F02.1.454.CMB.1.raw
tcagagtacgctatcacgaccggtgctcgatttagctcgatatagttgggtctggggagaggagccccccgccctgggtttccccaggttgttctctatttggtgatcagcactgcacaacagaagagtcataggacggtaggtttgggctgagtcgtttgggttttccttgttgtctttaagtttttaaaggtcgttctagtggtggaggttgcgagcgttggtgggaggttcgggtagggggtggtcgttcggtccgacggtccgggttccgggggtacctggacgtacccgttccttccgttggtacgcgacgtccttacggttggttacctttaccgtaccgtttacgtaacgttttaagttttcgttctaacgtttgtcggtaaccgtccgggttccgggtaccccggtacccggtaccggtccggttaaaccggggaacggggtaaaccgggaagtttaacgggtaaacgtttgtacggttaacgtaacgggttaaagtttaaggtaaaggtaaagttaacggtacgtaaacgttaaaacctaaaagttaagtaattttaagtaacgttaacgaaccgttaacgttaggtaggtaaacggaacggcgtaacttacgtaaccttacctaccgtaccgtaaccgtaacgggtaaccttaaacgtaaccgtaaacgtaacctaacgtacgttaacttaccgtttaagtaacgttaaggtcgtacgtacgttacgggtaacggacgtagggtaccgtaaggacggacgttaaccggttaagttacgttacgtttaaaccgggtttggtacggggttaaagggtacggggaaagggttaacggttaaaccgggtttaaacgggtttacggggttacggggtttaagggggttaaccggggggttaaccggtaacccggggggtaccgggg

SEQ ID NO: 267826 - DNA, 821 bp, Homo sapiens
  misc_feature: GYAE6OF01D3M4X.28.57.F02.1.454.CMB.1.raw
tcagagtacgctatcacgaccggtgctcgatttagctcgatatagttgggtctgggagaggagcccccgccctgggtttcccaggttgttctcgatttggtgatcagcactgcacacagagagtcatgacggtagtttgggctgagtcgttgggttttccttggtttgtctttaagttttttaaaggtgtacctagttggtaggagggttcgcgaggtcgttgggtggaggtcgtggggggacgtcgttcgggtccctaggcccgggttcgggggggtacccttggaacgtacccttccgttcgttcggtgaccgacggttccttacgttggtacttttaccgtaacctttcgtaaggtttattttaacgtcgtactaacgttcgacgttacggtccggggtcccgtccgtacggggtacgttacccggggtagggggtaaaaccggggttcaaggggttaacctagttcgttacgacggtttaagtaacgtaagtaagtagtacgaacgttaaactaatactttataacgtttgaacgttaacctaacgttgttaggaacggaggtacgtaactctacgtaacctgttacccacggtaacgacgtaactaccgaacgacctacgactttacgttacttaccgtaagtaagtccgggtactaccggacgtagacggacgttaccgagacccgggagtccgttacgtaacgtttagtaacgtttacggagggttaagggcggtaaagggtaccgtacggttaaagggttacgggttaacggggttagggttttacggggacggggttacccgtaacccgggg

SEQ ID NO: 267827 - DNA, 860 bp, Homo sapiens
  misc_feature: GYAE6OF01CZB3C.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttggggctgagtcgttgggtttttccttgttgtcttaagttttttaaaaggtgtccaggtgtggaggtgcagcgtgggtggaggtcggtgggggaggtcgttcggtccacggccggtcgggggggttccctggaacgtaccgtcctcccgtggtcgccgtacgtcccgttcgtaggtactttccctaaccgtttcgtaagttttactttagtcgtacttagtacgtccgtaccggtcgggtcccgaccgacggtccgtaccggaagggggaacggtacgtaaggtaattgtacgttctacggtaggttaaagttaacgaaagttaatcggaaacgtaaactaaacgtaattaagtttaatttacgtaacgtaaccctaaacggtttgtaggtaagggaaacggaccgtaagtaaccttacccaaccgtacgtacccgttaaccggaaggtaaacctaacgttaacccggaaacgtaaacccggtacgtacccgtttaaaggttaaaccctttacgtttaaaaccgtaaacgggttccgggtaaccgaaccgttaccggtaaggaacgtccggtaacgttacgggaacggtaccgtaacggttacttaacggtaatttacgggttaccggtaggggaaggggaaggtacgggggaaggtttaaccgggtagttaacccgggggtaaaggtttggggggtaacggccgggggacgggtaaaccgggg

SEQ ID NO: 267828 - DNA, 728 bp, Homo sapiens
  misc_feature: GYAE6OF01DL9C2.28.57.F02.1.454.CMB.1.raw
  modified_base (502)..(502): a, c, t, g, unknown or other
  misc_feature (502)..(502): n is a, c, g, or t
  modified_base (510)..(510): a, c, t, g, unknown or other
  misc_feature (510)..(510): n is a, c, g, or t
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
  modified_base (555)..(555): a, c, t, g, unknown or other
  misc_feature (555)..(555): n is a, c, g, or t
tcagagtacgctatcacgaccggtgctcgatttagctcgatatagttgggtctgggagaggagcccccgcccttgggtttcccaggtgttctctatttggtgatcagcactgcacacagaagagtcatgacggtagtttgggctgagtcgtttgggtttttccttgttgtcttaagttttttaaaggtcgttccagttggtggaggtcgcgtacggtcgttggggtcgggagttacgggtgggggggacggtcgtttcgggttcccgaacgggtcccggggttccgggggggttcccctaggtaccgtaccttccgtccctggtacgaccgtacgtccttacggtggtaactttcctaaccgtttactaacgttttaattttcgtcgttcttagcgtaaccgtcgggttccggggtccccgccggacggtccgtaccgggaagggggaacggtacgtaggttaatacgttcgtatacggtagtaaagttaggaatagtgaanaaactaanattataattcatactactgnggtagaggactntactactactacncgtacgaacggactaacctaacgacaacctagtcttagtacttacttaacgaagtacggcgacgtcgagacgtgacgtggaacgacggacgtctagtagttgtacggtaggaggaggtaacggtagacgttaagggtacggttacggttagggtcggtcgggtcggtaccggg

SEQ ID NO: 267829 - DNA, 742 bp, Homo sapiens
  misc_feature: GYAE6OF01B1N9D.28.57.F02.1.454.CMB.1.raw
  modified_base (221)..(221): a, c, t, g, unknown or other
  misc_feature (221)..(221): n is a, c, g, or t
  modified_base (454)..(454): a, c, t, g, unknown or other
  misc_feature (454)..(454): n is a, c, g, or t
  modified_base (645)..(645): a, c, t, g, unknown or other
  misc_feature (645)..(645): n is a, c, g, or t
tcagagtacgctatcacgaccggtgctcgatttagctcgatatagttgggtctgggagaggacgcccccgccctgggtttcccaggtgttctcatttggtgatcagcactgcacacaagaagagtcatgacggtagtttgggctgagcgttcgggttttccttgttgtcttaagtttttaaaaggtgtccagtgtggaggtgcagcgtgggtggagtcggngggggacgtcgttggtccaggtccggtcgggggtcctggacgactctctgtgctagcctgtagtctaccgtaccttgtattagttactgtcttagcgcgtacggtcgggtcccacgacggcctaaccggagggtaacgtacgtaggtaagttacgtcgtacctaggtaaggttaagtaaggtaaagtttacgacggtaataaaacctaaagtaattaaggtttaataacgtanaaccgtaattggtaggacgtaacggatacgtactaccgaactacgtacggtacgaagtaaacctacctaaacgaacgtaacccgtagtcgttaagttacttacgtaacggtaaggtccggacttacgaccgtaggaacgtacggaccgtaggtaaccggccgtcggttaacgttagttaaaccgggtttanacggggttaggtaccgggaaagaccggggttaagaacggggtttaacgttaagggtaacggttacgggggggtcgtaaccggggtacgggaaccggg

SEQ ID NO: 267830 - DNA, 821 bp, Homo sapiens
  misc_feature: GYAE6OF01EV0OL.28.57.F02.1.454.CMB.1.raw
  modified_base (358)..(358): a, c, t, g, unknown or other
  misc_feature (358)..(358): n is a, c, g, or t
  modified_base (768)..(768): a, c, t, g, unknown or other
  misc_feature (768)..(768): n is a, c, g, or t
tcagagtacgctatcacgaccggtgctcgattttagctcgatatagttgggtctgggagaggagcccccgccctgggtttcccaggtgttctcatttggtgatcagcactgcacacagaagagtcatgacggagtttgggctggagcttgggttttccttgttgtcttagtttttaaaggtgtccagtgtgacgatgcagctggtggagtcgtgggggagcgttggtccaggtccgtcggggggtccctggacgaccttccgtccgttggtacgcacggtccttacgtggtactttccgtaacctttacagtttatttactggtacttaacgttcggactaccgttcgggggtacccnccggacgggtaccgttaccccgggaagggggttaaacgggacctaggggtaaactttagttcgttcggtacgtaagggtttaagttaagaaaggttaactacggaaccgtaaataaactagtttaattaactttagacggtaaaccaaacgttacgtacggtaaggtaaccggggtactaaggtaacctttaccgaacccttagtaccccgtaacggtaacgggaaacttaacgttaaaccccgaacgtaaaccgtaccgtacttaaggttaccttaacgttaccgtaaaagtcgggttaccaacggttacccgtaggtacggtcgtaacggtacgaacccgggtacgcggtaacgttaacggttaattacgggtttaacgtggggtaagggtaccgaaggggtaaccgnggttaaaacgggttcggtaaaggggtttcggggttcgggtaacgggtaccggg

SEQ ID NO: 267831 - DNA, 841 bp, Homo sapiens
  misc_feature: GYAE6OF01BZW74.28.57.F02.1.454.CMB.1.raw
tcagagtacgctatcacgaccggtgctcgatttagctcgatatagttgggtctgggagaggacgcccccgccctgggtttcccaggtgttctctatttggtgatcagcactgcaacacagaagagtcatggacgggtaggtttgggctgaggtcgttcgggttttcctttggttgtacgtttaaagttttttaaaagggtcgttaccgtaaggttggtggagggtgcgaggcgtggggtggaggtcgggtggggggagtcgtttggtacccgaggccgggttcgggggtcctaggacgtactcctccgtgtcgccgacgtccttacgtggttactttcccgtacctttatagtttatttaagtcgtagttagtcgtcgtacgggttccggggtccccgaccggtacggccgtaaccgggaaggggaacggtacgtaaggtaattacgtcgtacgtacgtaaaggttaagtaaggtaaacgtaagacggtaaacaaaattaacgtaatttagtaaacttagtacgtaaacttaaacgttggtaaggtaacgggaagggtaaccgtaagttaccgttaacccgaaccgttaccgtacccggtaacgggtaaaaccggttaactaaaacccggttaaccgaaaaccggtaacgtaaccggttacgttaacgtttacgttaactaaaccgggtaaaggtccggtacgaacggtcggtagggacgttacggacggtacggaacgacggtacgttagtacgttagtacggtaggggtaggaggaacggagggtacggtaaggtttacggaacgggtttcggggtaggacggggtcggacggggtccg

SEQ ID NO: 267832 - DNA, 885 bp, Homo sapiens
  misc_feature: GYAE6OF01D7UQ4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagttgggctgagtcgttgggtttttccttgttgtactttaagtttttaaaggtcgttaccgtaggttgtggtaggtcgcagcgttggtggtagtcggtggggaggtcgttcggtccgacggttccggttcgggggtaccctaggacgtctccgttccgtaggtcgcgacgtccgttgtggtacttacctaccgttacgtaagtttacgtttacgtacgttaccttaagtccgtacgtccggtttccgggtacccgaccggtaccgggtcccgtaaccggggaacgggggaacgggtacgtaggttaacgttgtccgttacgtaacgttaaggtttaaagttaacggtaaagttaagtacgtaacgttaaaactaacttaacgtttaattaacgtttacgtaacggtaaacccttaaacgttcggttaacggggtaaaggtaacgggtaccgttaagtacccttacgtaacccttacgttaccggtaaccgtaaacggtaactaaccgttaaccggaaacgaacttacggtactttaacgtaccgttaacgtaacgtaagggttccgaacgtccgggtaccgtaaggacgtaaggttacggaggtaaccggtacggtaccgttacgtttacgttaccgttaaggtttacccggtagggtaccgggaaaggtcggggtaaacggttacggggtaaaccggtttaagggtacggggtttaaggggtcgggttacccggggaagggttacccgggg

SEQ ID NO: 267833 - DNA, 918 bp, Homo sapiens
  misc_feature: GYAE6OF01C874M.28.57.F02.1.454.CMB.1.raw
  modified_base (756)..(756): a, c, t, g, unknown or other
  misc_feature (756)..(756): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcagtgacggtagtttgggctgagtcgttgggttttccttgttgtctttaaagtttttaaacggtcgtaccgtaggttgtggaggtgacgaggtcggtgggtggacggttcgggtagggggtaggtccggttcgggtacccgacgggtcccggggttcggggggttccctaggtaaccggtaccttccgtccggttggccgtaccggccgtccgttcgtcggttaccttacccttacccgtttagttaacggtttaatttgtacgtcgttaacgtccggacccgtacgggtcccggggtaccccgacgggtaaccggtcccggtaacccggggaaaggggtaaaccggtacggttaacggtaaagttcgttacgtaccggttaaggttaaggtttaaacgttaaaggaaacggttaagtaaccggtaaacgttaaaaacttaactaaaggtttaacttaagtacgtaacgtttaaacctaaacgttcgggtaagggtaacggtaaacggtacgttaacgtaaccttaccgaacttaccgtaccgtaacggtaaccggtaaacctacgtaaccgaaacgtactaccgttattacgtacgtttaccgaaggacggtcgacccgtaaggtaccggngaaccggttcgaaaccggtagacgggtaccgtacgggttatttaacggtaccgtttaaggtagggtacgggtaagggaacgggtaggaaccgggtaaggtttaaacccgggtagggggtaacggtttcgggggaaccggtcgggggtaaccggtcccggggg

SEQ ID NO: 267834 - DNA, 1013 bp, Homo sapiens
  misc_feature: GYAE6OF01B2NJW.28.57.F02.1.454.CMB.1.raw
tcagagtacgctatcacgaccggtgctcgatttagctcgatatagttgggtctgggagaggacgcccccgcccgtgggtttcccaggtgttctctatttggtgatcagcactgcacacagaagacgtcagtagacgggtagtttgggcttggacgtcgttgggttttcctgttgtactttaagttttaaggtcgtctaggtgtggacggtgacgtaggtcgttgggtagggtacggttcggggtagggggtacgtcggtttacgggccgtacgggttccggggttcggggggtccctaggtaaccgtccttcgtcggttcgcgaccgtcgtccgttacggtagttacttccctttaaccgttacgttaaacggttttactttagtccggttaacttaacggtcttacccggggaccggttaccgggggtcccaaccgggtaacggtttccccggtaaacgggggaaggggtaacggtttaaccgaagggttaaacttaccggtaccggtttaacgtaacgggtttaaaggttaagttaaaaaccgggtaagtttaacggaaaccgggttaaaacgttaaaaaacttaaacggttaacttttaagggtttaaaacctttaaggaaccttaaaaccgtttaaacccgttggggttaaaagggtaaacggaaaacggggtttactaaccgtttaaaccttaaccggtaccctttaaccgtaacccggtaaacgggtaaaccgggtttaaaccaaaacgttaaaccccggaagtaaaccgggttacttacggttaaaccggttaaccgtttaacggtaaactttaacggggaacgggtttaccgaccgggttaaccggaggacgttaacccgagggttaaccgaggttaacgtccgtaaggttacgtaagtttaacggtcggtaaagggagggttaaggaaacgggttacgggtaaagtttacggggtaacggttaggggttaaccgggtcggggtaggtaaccccgggtaaccggg

SEQ ID NO: 267835 - DNA, 789 bp, Homo sapiens
  misc_feature: GYAE6OF01CH41M.28.57.F02.1.454.CMB.1.raw
  modified_base (707)..(707): a, c, t, g, unknown or other
  misc_feature (707)..(707): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagttgggctgagtcgttgggttttccttgttgtacttatttttaaaggtgtacctagtgtgaggtgacagcgtggtggtagtcggtgggggacgtcgttcggtccaggtccggtcggggggttccctaggacgtaccttccgtcctggtcgcgacgtccgttcgtcggtacttacccgtaccttacgtagtttaactttatacgttcctaatcggtacctaaccgggttccgggtcccgaccggacggtccctaccggaacggggtaacgggtacgtaggaaagttcgtacggttacctaggtaaggttaacttaaggttaaagaacgtaggtaacgtaaattaaacgtaaactttagttaacttaagtcgttaaactaacctttaacggtaggtaacggtaaaacgggacttaaggtaaccctttacccacgtaaccgtttaccgaacggtaaaacggtaaactaaacgtaaccgaaacgaaaccgtccgtaacgttacgtaacgtttactaacgtaacggtcgacgtaacgtaccgaggttacgaaccggtgtaaggacgggaaccctaggtnttaacgtacgttacgttaggtcgggtagacggaggtaacgtaggtacgtaaggtaacggttggggtacgtgggcgtaccggg

SEQ ID NO: 267836 - DNA, 833 bp, Homo sapiens
  misc_feature: GYAE6OF01DOVWX.28.57.F02.1.454.CMB.1.raw
tcagagtacgctatcacgaccggtgctcgatttagctcgatatagttgggtctgggagaggagccccccgccctgggtttcccaggtgttctcatttggtgatcagcactgcacacagaagagtcatgacggtagtttgggctgagcgttgggtttttcctttgttgtctttaagttttttaaaggtgtcctaggttgtggtaggtgcaggtcgtgggtggaggtcggtgggggaggtcgttcggttccacggtcccggtcggggggttcccgtagacgtaccttcctccgtgtcgcacgccttcgtcggtactttcctacccgtttactaagtttagttttagtcgtacttagtcgactaccggttcgggtccccgccgacggtcccgtacgggaaacgggggaacggtacgtaggtaaagttagtacgttccgtaacggtaaggttaagttaaggaaaagttaatacggtaaacgtaaataaactaattaatttaatttaagacgtaaactaccttagttaggtaaggtaacggactaacgtacttaccgtacctacgttaccgtacggtaaccggtaacttaaccgttaacccgaaacgaactaccgttacgttacgttaccttaacttaacgtaacggttcggacgttaaccggccgtaaggtaacggtaggtacggaaggtaacgggtaccaacgggttacttaggttaaacgtttaggttaacgggttagggtaaggggtaagggaaggggtaacgggtacggttaaacgggttagggttaaaccgggtttagggggttacggggtcggggacgggtaacccggggg

SEQ ID NO: 267837 - DNA, 828 bp, Homo sapiens
  misc_feature: GYAE6OF01CEWO9.28.57.F02.1.454.CMB.1.raw
  modified_base (289)..(289): a, c, t, g, unknown or other
  misc_feature (289)..(289): n is a, c, g, or t
  modified_base (453)..(453): a, c, t, g, unknown or other
  misc_feature (453)..(453): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcttgggttttccttggttgtcttaatttttaaaggtgtccagtgtgaggtgcagcgtgggtggagtcggtgggggagtcgttggtccgacggtccggttcggggggtccctggacgtacctcctcctggtcgcacgtcctcgnggtcttcctaccttcgtagtttagtttatcgtcttaagtcgacgtaccggtccgggtacccgccgtaacgggcctaccgggaagggggaaacggtacgtaggtaatacgttgtaccttagtaaggttaagttaagtaaagtacgtaggtaacgtaaaacttaanaacttaattaattacgtacgtaaactaaacgttggttacggtaagggaacggtacgttaagtaccttacccgaacctaggttacccccaacgggaacgtaacttaaaccgtaacccgaaaaacgtacccggacgttacgttaaggtttacctaacccgtttaaaggaacgggttcgggaacccttacggtaccgtaaggaaccgggtgtacgtaacgggaacccggaacggtcgttcgttaaggtttactagggtacggtcgggggttaaaggaggggttaaccgggaaacggtttaacgggttaaacgggtttacggggtaaacccggggttttagggtacccggggggtcgggaacccgggggttacccgggg

SEQ ID NO: 267838 - DNA, 862 bp, Homo sapiens
  misc_feature: GYAE6OF01BFOC9.28.57.F02.1.454.CMB.1.raw
tcagagtacgctatcacgaccggtgctcgatttagctcgatatagttgggtctgggagaggagccccccgccctgggtttcccaggttgttctctatttggtgatcagcactgcacacagaagagtcatggacggtaggtttgggctgagtcgttgggtttttccttgttgtactttagtttttaaaggtcgtcagtgtgaggtgcagtcgtgggtgggtagtcggtgggggacggtcgttcggtccacggtccgggttcggggggtccctgacgtcctcctccgtgtcgcacgtccttcgtagtaccttccgtacctttataagtttatttacgtgtctactcgaccgtcggtccgggtccccaccggtacggccgtaccggaggggaacggtacgtaggtatcgtgttactacgtaaggtaagttaagtaagtaactacgaacgtaaaactaataattagtttattacgtataaccgttaaacttcggttaggtaacggagggtactacgtaccttacctaacccgttcgttaacccgaccgggaagttaaacctaacccgttaaacggaaccgtaaccgtaccgttacgtttaacttaccttacgttaacggtaagggtccggacgtaccggtacgtaagggattaccggtacgtagggaacccggtacggcgggtttaactttaaagggtttaacgtaggttttttaccggggggaaagggttgggggaaacgggggttaaggtaaacccggggtttaaggggttaaaaaccgggggttttaacggggtaccggggggtttaaagggggggggttccccggggtaaccgggggggacccgggtttaaacccccggggg

SEQ ID NO: 267839 - DNA, 746 bp, Homo sapiens
  misc_feature: GYAE6OF01D87ZD.28.57.F02.1.454.CMB.1.raw
  modified_base (315)..(315): a, c, t, g, unknown or other
  misc_feature (315)..(315): n is a, c, g, or t
  modified_base (361)..(361): a, c, t, g, unknown or other
  misc_feature (361)..(361): n is a, c, g, or t
  modified_base (632)..(632): a, c, t, g, unknown or other
  misc_feature (632)..(632): n is a, c, g, or t
tcagagtacgctatcacgaccggtgctcgatttagctcgatatagttgggtctggggagaggacgccccccgccccttggggtttccccgaggttgttctctagtttgggtgatcgagccacgtgacacacaggaagagtcagtggacggtaggtttggctgagtcgtttggttttcctgttgtactttaagttttaaggtcgtactaggttggtagaggtcacgtagtcggtgggtaggtcggtcggggtgggggtacgttcggttcggaccgtacggtccggggtcggggtccctaggacctcttcctacggngtcgacctcgtcctgtgtactctactcgtagttatatcgattacgngtacggtaccggtcggtccgtacggcggtaccggtaacgggtaacgggaacgggtacgtaagtacgtattccgtaacctagggtaggtttaaagtaacggttaaagtacgtaacgaaaagttaaataataaacgtttagtagtaacgttaaccgaaccgttaaagttccggtaggtaacggggaactagtacctacgtacctaacgtctacggtaacgtacgtaacgaaccgaactaacgacctagtacctacgtaacgtacgacgtacgngtacgcgagtagcgtagacggcgatacgtattacgtacgtggagtgggtacgagggtacgacgggtagtaacgggtagtaccggggttagacgggggtcggacggtggtaccgg

SEQ ID NO: 267840 - DNA, 689 bp, Homo sapiens
  misc_feature: GYAE6OF01CS38X.28.57.F02.1.454.CMB.1.raw
  modified_base (191)..(191): a, c, t, g, unknown or other
  misc_feature (191)..(191): n is a, c, g, or t
  modified_base (265)..(265): a, c, t, g, unknown or other
  misc_feature (265)..(265): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagagtacgctatcacgaccggtgctcgatttagctcgatatagttggtcgtgggagaggagcccccgccctgggtttcccaggtgttctcatttggtgatcagcactgcacacagaagagtcatgacggagttgggctgagcttgggttttccttgttgtcttattttaaaggtgtccagtgtgaggtncgagctggtggagtcgtggggagcttgtccagccgtgggggtccctggacgtctctccgtgtgactagcccttntaggtacttcctaccgttctaagttactttaatgtacctagtcgtacacgtcggtcccncgacgctacggagggaggactaggatagtcgtctagtagtacgtanaagtatgaacctaagtaatataagttattatacgtaactaacttcgtaggtagacggactagtactaccactactaccgtacgaacggactaacgtaccgaacgaactacgtacgtacgtattactaacgaagtcgaacgtacgtacgtacgagtaacgtcgaacggtacgggacgttaccggtagttaaggtacttaaggtttggaacgggtttagggaaagggtaacgggtaacgggtaacgggtttaaacggttaacggggtaaaccggtttaggggggtacgggtaacccgggggggtaccggttaaacccgggg

SEQ ID NO: 267841 - DNA, 690 bp, Homo sapiens
  misc_feature: GYAE6OF01AR6CW.28.57.F02.1.454.CMB.1.raw
  modified_base (455)..(455): a, c, t, g, unknown or other
  misc_feature (455)..(455): n is a, c, g, or t
  modified_base (570)..(570): a, c, t, g, unknown or other
  misc_feature (570)..(570): n is a, c, g, or t
  modified_base (674)..(674): a, c, t, g, unknown or other
  misc_feature (674)..(674): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtcttagttttttaaaggtgtcctagtgtggaggtgcagctgggtggacgttcgtaggggggaggccgtttggtaccgacggtcccggttggggggtcccctggacgtacctccgtcctggtcgcgacgtcctcgtcggtacttccgtaccttcgtaacgttattttagtcgcttatcggcctacggttcgggtcccgccgacggccgtacggaagggacggacctaggaactagtcgtcgtagagttagtaacgagttaagacgtaacgaaattaaacagtttaatacgttancgtaactaacttcgtagtaacggagtactaacgtacttaccaactacgtactaccggaacggaacctaataacgtaaacgactacgtactagttactacttaagaacgtcggacnccgtacgacgacgtacgagtcggaacgaccgtacgtacgtacgttaagttacgttacgtggtagggaggtacggaggtaaggtacggttaaggacgttaggggnggtcgggtcggtacgg

SEQ ID NO: 267842 - DNA, 810 bp, Homo sapiens
  misc_feature: GYAE6OF01DN3WC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgtcttaatttttaaaggtgtccagtgtgaggtgcagcgtggtggagtcgtgggggagcttcggtccagccggtgggggtccctggacgactctcctgtcgcagcctcgtggtacttccaacctttcgaagttattttagtgaccttatcgcctacggtcggggtcccgaccgtacggcctaccggaagggggtaacggtacgttagggaacttagtcggtctacggtaggttaattaaggtaaacgttaatcggaacgtaaaattaaaactaagttaatttaaactttaagtacgtaaacctaaacgttacgttaggttaaagggaaagggtacctaaggtaactttacccaacccgttaaccgttccgtaacccggaacgggtaaccctaaacgttaacccgaaacggaaccctacgtaccgttacggtactttacgttaacgtaaggtacgggacgtaagtccgtaaggaacggtacggacgtagggaacggtaccggaaccggttccttaaggttaactttacggttacgttacggggaacggggtaagggtaagggtacgggttaaccgggttaaagggtttacggggttaaacgggtttagggggtttacgggggtcgggggtaacccgggtaaccgggggg

SEQ ID NO: 267843 - DNA, 898 bp, Homo sapiens
  misc_feature: GYAE6OF01EHLI0.28.57.F02.1.454.CMB.1.raw
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
tcagagtacgctatcacgaccggtgctcgatttagctcgatatagttgggtctggggagaggagccccccgccctgggtttcccagggttgttctctatttgggtgatcagcactgcacacagaagagtcatggacgggtaggtttgggctaggaggtcgtttgggtttttccttggttgtactttaagtttttaaaggtgtaccagtggtgaggtncgngcgtggtggaggtgggtgggggaggtcgttcggtaccgcggtccgggttcggggggtccctggacgtaccttcctccgtgtcgacgcgtcctgtcgtacttcctacctttacttaagttatttagtcgtacttagtcgtccgtacgggtccgggtcccgccggacgggtccggtacggggaacgggggaacgggtacgtaggtaagtttagttcggttactaagggtaaggtttaaacgtaaaggttaaagttaaggtacgtaaacgtaaaactaaattaaattaactttaagtttacgtaaccgtaaacgttaacgttacggtaaggtaaacgggtaaggtacgtaacgttacctaacccgtaaccgtaccttaccggtaacgggtaaccggttaaacctaacttaaaccggaaaaccgtacgtacccgttagtttacgttaacttaccggtaaagttacgggaacggtcgtaacgtccggtacgaagggtaccgaacggttacggaaccgggtacgtaccggttagttaacggttacgtttaagggttacgggtagggggtaggggaacggggtaagggttaacccggggttaaagggttaaaccggggtttacgggggttaaccgggggtttaagggggggccgggggtaccgggggtcgggttaaacccggggg

SEQ ID NO: 267844 - DNA, 823 bp, Homo sapiens
  misc_feature: GYAE6OF01C8U56.28.57.F02.1.454.CMB.1.raw
  modified_base (125)..(125): a, c, t, g, unknown or other
  misc_feature (125)..(125): n is a, c, g, or t
  modified_base (414)..(414): a, c, t, g, unknown or other
  misc_feature (414)..(414): n is a, c, g, or t
  modified_base (718)..(718): a, c, t, g, unknown or other
  misc_feature (718)..(718): n is a, c, g, or t
  modified_base (758)..(758): a, c, t, g, unknown or other
  misc_feature (758)..(758): n is a, c, g, or t
tcagagtacgctatcacgaccggtgctcgatttagctcgatatagttgggtctgggagaggacgcccccgccctgggttcccaggtgttctcatttggtgatcagcactgcacacagaagacgtnatcggacggtaggtttgggctgacggtcgtttcgggttttcctttgttagtacttttaaagtttttaaaacgggtcgttaccgtaaggttggttacggagggtcgacgtaggccggtgggtacgggtaaggttcgggggttaggggggacggttccggttcgggtacccgacgggtcccggggttccgggggggtacctaggaaccgttcttccgttccgtggtcaccgacggttccccttggtacggttaccttacccctaaccgttagttaaacgttttaagtttanccggtacttaagtccggacgtaccggtaccgggggtaccccacggaacgggccctaccggggaaagggtacgtacgaaggtaatcgttgacgtacgggtaaagtagtaacgtaaaagtcgaaagtaacgtaaaattaataagttaataattaacggactaacgtaaccgtacgtaagggtaaggaacggctaacgtaattaacccgactaacgtacccgaacggaacccgtaaagtaaccttaacgaaacgtacgaacgttactacgtactaacgtactaaggccgtaacgtcgacgtagaccnggactaggtacgacgtacgtacgttataacgtatacgggnggacggtaggacggacggaggttacggtaaacgggtagggttaggacgggtagggccggtacggg

SEQ ID NO: 267845 - DNA, 637 bp, Homo sapiens
  misc_feature: GYAE6OF01AYIBG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggattccaccttcagttatttatgctatgcacgtgggtcccgccaggctccgagggaggctaggaatatgtctacgaggtattagaagtatgacgaataacatatattatgactaaactgtggtaggaagggcaggtacttaccacctagtccctaccgaacgggtaacctaacttacccaaacggacctaacgtcttagtaacttacttacgaaaggtcgggacgtacgacctaggaacgtgacgttaggaacggtaccgacggtacttaggttaaacttacgttacggttgggtagggggtaacggaagggtacggtacgggtaaggttacgggtaacgggttaggggtggggttacgggggaccgtaacgggggg

SEQ ID NO: 267846 - DNA, 737 bp, Homo sapiens
  misc_feature: GYAE6OF01EDKNN.28.57.F02.1.454.CMB.1.raw
  modified_base (340)..(340): a, c, t, g, unknown or other
  misc_feature (340)..(340): n is a, c, g, or t
  modified_base (403)..(403): a, c, t, g, unknown or other
  misc_feature (403)..(403): n is a, c, g, or t
  modified_base (556)..(556): a, c, t, g, unknown or other
  misc_feature (556)..(556): n is a, c, g, or t
  modified_base (590)..(590): a, c, t, g, unknown or other
  misc_feature (590)..(590): n is a, c, g, or t
tcagagtacgctatcacgaccggtgctcgatttagctcgatatagttgggtctgggagaggacgccccccgccctgggtttcccgaggttgttctctatttggtgatcagcactgcacacagaagagtcatggacggtagtttgggctgagtcgttgggttttccttgttgtactttaagtttttaaaggtcgtacctagttgtgaggtgcagtcgtggtaggtagtcggtgggggagtcgttcggtccaggtccggtcgggggtccctggacgtacctccgtctgtcgcgtacgccgttcgtagtacttccgtaccttcgttagtttactttagtcgtntagtcgaccgtacggtccggccgcgcggccgtaccgggaaggggaaccggtacgtagtaagtntcgtacgtagtaagttaagtaagtaactagtacgtaacgtaaataactaattaagttaattacgtacgtaacttaacgttcgtaggtaacgacggtactagtacttaccgactacgacgtacgaacgtaactaacgtacgaaacgtacacgtnttacgtacttaaccgttaggtaaggtcgacgtanaccggtagaaccgtgacgttacgacggtactaccgggtattagttaccttaagttcgggtaggtagggtaaaggggtgtaaacgggtaggtttaaagttacgggggtacggtttaggggtaggggacccgggtagggtacccggggg

SEQ ID NO: 267847 - DNA, 895 bp, Homo sapiens
  misc_feature: GYAE6OF01BAEVG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcagtcggtacggtaggtttgggcctggacgtcgtttcgggttttccttggttgtactttaagtttttaaaggtcgttccgtagtggtgtaggtcgcgacggtgttgggtaggtacggttcgggtagggggtcggtcgttcgggtccgtacggtccgggttcgggggtccctaggacgttcctccgttcgtggtcgacgtcgccgttcgtaggttaccttaccgttaccgttacgttatttaacgttacgtacgttacttacgtcggtaccggtaccgggtaccggtcccggtaccggtaccggtaccggtacggggtaaacggggtaacggtacgttaacggttaacgttacgttacgttacgttaggttaacggttaaagtaacggtaacgtaacgtaacgtaaacgttaaacgtaacgttaacgttaagttaacgttaacgtaacgttaaccgttacggttacggtaaggtaacggtacgtaacgtaacgttacccgtaacctaccggttccgtaccggtaacgtaacgttaaaccgtaacgtaaccgaaacgtcccgtacgttaacgttacgttaacgtacgttaaacggtacggtcggtacaaggtacgtaacgacggtaccgtagtaacggtacggtcggtaacgtacggtttaagttacgggttacgggttacggtaggggtaaggtacgggtaacggttaacggttaaacgggttaggttaaacggggttacggggttaccggacgggtaacgggacgggtaccg

SEQ ID NO: 267848 - DNA, 689 bp, Homo sapiens
  misc_feature: GYAE6OF01CMIW7.28.57.F02.1.454.CMB.1.raw
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (377)..(377): a, c, t, g, unknown or other
  misc_feature (377)..(377): n is a, c, g, or t
  modified_base (487)..(487): a, c, t, g, unknown or other
  misc_feature (487)..(487): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttaagtttttaaaggtgtccagtgtgaggtgcagcgtggtggagtcgtgggggagcttggtccagccgtgggggtccctgagactctcctgtgcagcctcgtgtattccaccttcagttatttatgctatgcacgtgggtcccgcacggctccgaaggggaaggactggaatntgtctnaggtatagaagtaatgacgaaatacatatattangactaaactgtgtagaagggtacagtacttaccaacctacttcccgtaccgaaacgggtaactaaacgttaacccaaagaaccaccgtctacgttaacttaccgtttaanaaacgttggggacctaacggtcccgttaaggaaccggtaggtacgttaacgggaccgggaaccgaaccgggtactttaacgggttaatttaacgttaccgggtttagggttacggggagggtaaagggacgggtacgggtaaaaggtttcggggtaaaggtttagggggtttacgggtccgggggtaccggtaaaccggggg

SEQ ID NO: 267849 - DNA, 699 bp, Homo sapiens
  misc_feature: GYAE6OF01AIGWS.28.57.F02.1.454.CMB.1.raw
  modified_base (135)..(135): a, c, t, g, unknown or other
  misc_feature (135)..(135): n is a, c, g, or t
  modified_base (145)..(145): a, c, t, g, unknown or other
  misc_feature (145)..(145): n is a, c, g, or t
  modified_base (289)..(289): a, c, t, g, unknown or other
  misc_feature (289)..(289): n is a, c, g, or t
  modified_base (316)..(316): a, c, t, g, unknown or other
  misc_feature (316)..(316): n is a, c, g, or t
  modified_base (357)..(357): a, c, t, g, unknown or other
  misc_feature (357)..(357): n is a, c, g, or t
  modified_base (443)..(443): a, c, t, g, unknown or other
  misc_feature (443)..(443): n is a, c, g, or t
  modified_base (579)..(579): a, c, t, g, unknown or other
  misc_feature (579)..(579): n is a, c, g, or t
  modified_base (618)..(618): a, c, t, g, unknown or other
  misc_feature (618)..(618): n is a, c, g, or t
tcagagtacgctatcacgaccggtgctcgatttagctcgatatagttgggtctgggagaggacgcccccgcccgttggtttcccaggtgttctcagtttggtgatcagcactgcacacagaagagtcatgacggngtttggctgngtcgttggttttccttgttagtctttaagttttaaggtcgtactggttgtggtcggtcgacgtgtcgtagggtggtacgtgggtaggggtcgtcgtttcggaccgcggtccgggtcggggtacctagagtcctccgtcgtcgtnacgcgtcctagcgttactactaccgtnttcgttattcgtacgcttagtccgacgtccggtcgtaccgngtcgacgtaccggaaggaccgtagtagtatcgtcggtactacggaattaggtaaacggacttagaacgttaaacgacttaaaagtnttaaaattgtaacgtactaacccttaagtcgtagttacggaacttgtaaacgacctagtaccgaactcgaacgtacgtaactacgtacacgtacgtaaccgtactacttaacgactaactacgagcgtacgtacgnggaaccgttcgagaagacccggttgaacctgttaaacgngtttaaacccggtggtaaggtcggaggtaaccggtaagtaacggtagtagggttaccgggtagttgggacggagggtcccg

SEQ ID NO: 267850 - DNA, 829 bp, Homo sapiens
  misc_feature: GYAE6OF01BC3XF.28.57.F02.1.454.CMB.1.raw
tcagagtacgctatcacgaccggtgctcgattttagctcgatataggttgggtctgggagaggagcccccgccctgggtttcccaggtgttctcatttggtgatcagcactgcacacagaagagtcatgacggtagtttgggctgagtcttgggttttccttgttgcttaatttttaaaggtgtccagtgtgaggtgacgagcgtgggtggagtcgtgggggagtcgttacggtccaggccgttggggggtccctggacgtaccttctccgtgtgaccgtacgtccgtcgtagtacttaccacccgtttagtaacgtttactttagtgtacttagtcgtaccgtacggtccggtacccgaccgtacggcccgttaaccggaaggggaaacggtacgtaggtaattacgtcggtacgttacggtaaggttaaatttaaggtaaaagtaagtagaaccgtaaataactaagttataaatttaagacgaactaacgtcgttagaacggacggtactaacggtacttaccaactacgttcccgaagtaaacggtaacttaaccgtaaaccgaaacgtaagtacccgttagttaacgtttaacgttaccttaacggtaaaggtaccgggttacaacgttaccgtaacggtagtaaccggttaaggaccggggtaacgaacccgtaccgggtttaagtttaaacgttacgtttaaaaccggttgggtaacgggttaacgggggaacgtaaaagggtccgggtaaagggttaaaacgggtttacgggtaacgggtttacgggggttacgggttacgggggacccggttaaacgggg

SEQ ID NO: 267851 - DNA, 813 bp, Homo sapiens
  misc_feature: GYAE6OF01D65B6.28.57.F02.1.454.CMB.1.raw
  modified_base (188)..(188): a, c, t, g, unknown or other
  misc_feature (188)..(188): n is a, c, g, or t
  modified_base (372)..(372): a, c, t, g, unknown or other
  misc_feature (372)..(372): n is a, c, g, or t
  modified_base (447)..(447): a, c, t, g, unknown or other
  misc_feature (447)..(447): n is a, c, g, or t
tcagagtacgctatcacgaccggtgctcgatttagctcgatatagttgggtctgggagaggagcccccgcctgggtttcccaggtgttctcatttggtgatcagcactgcacacagaacgagtccatgacggtagtttcgggcttggagtcttgggtttttcccttgttgtacttagtttttaaaggngtccagtgtagtaggtgcagtcgtggtggtacgtcggtcgggggaggtcttcgggcctacggtccggttcggggggtccctaggtacgtaccgttcctccgtggtcgcgacgtccgttccgtaggtctttaccaccgtttcgagttattactacgtctacgtcgtaccgtacgtcggttacccnccggacggtccgttacggaaaggggacggtatacgggtaatcggttgtcgtagacgttaagtacgaaacgttagngtaacgtaagttaaccaagttaatttacggtactacggtaactaacgttcgtaacggtagggtaacgtacggtaacttcgttaacccgtaacccgtccgtttaaccaaccggggtaaacggaaccttaaacgtaacccggaaacggttaccgtaccgttaaacgttacgtttaacctttaccggtaacgaacgttgggaaccttcggggaacgtgacgggtacccgttagaggtaacccgtgtacccggtttagtagtttacaccgggttaggaacggtacggggtaggtaaaccgggtcgtaacgggttaaacggttacggggaacgtttacggggggtacgtcggggaaaccccgggttacggg

SEQ ID NO: 267852 - DNA, 919 bp, Homo sapiens
  misc_feature: GYAE6OF01AY9GX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaagtttttaaaggtgtccagtgtgaggtgcagcgtggtggagtcggtgggggacggtcgttcggtccgacggtccgggttcgggggggtcccctggacgtaccttccgtccgtggtcgcctacgtcccttcggtggtaccttcctacctttacgtaagtttatttagtcgtacttagtcggtccgttaccgggttccggggtccccgaccggacgggtacccgtaccggggaaacgggggtaacgggtacggttaaggtaacgttcgttacgttaccgttaagggttaacggtttaaggtttaaggtaaacgttaaggtacggtaaacgttaaataaacttaatttaagtttaagttacgtacgtaacctaaacgtttcggttagggtaacgggaacgggtactaacggttaacccttaccgaaccctttacgggtaccccgtaaccgggtaaacccggtaaccttaaacgttaaccgaaaccggtacctaccgttacttaacgttacttaaccgttaacggaaggtccggtaccacggtaccgtagggtacgtccggaagtaccgggtaaccgtaccggtacggttactttaacggttaaacggttacccggtttaaggggtacggggttaacggggaaacgggttacggggttaaacgggtaaacggggttaaacgggttttaaccggggggttaacggggtttagggggggttacccgggggtaccgggggaacccgggttaacccggggg

SEQ ID NO: 267853 - DNA, 883 bp, Homo sapiens
  misc_feature: GYAE6OF01BBND9.28.57.F02.1.454.CMB.1.raw
  modified_base (800)..(800): a, c, t, g, unknown or other
  misc_feature (800)..(800): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatggacgggtaggtttgggctaggagtcgttggggtttttccttgttgtactttaagttttttaaacgggtgttaccaggttggtaggagggttgacgtaggcgttgggtgggtaggttcggtggggggaggtccgtttacgggtccacggtccgggttcggggggtccctggacgtaccttcctccgttaggtcgactacgtccgtcgtcggttacttcctaacccgtttacgtaagttttaacttttagtaggtaccttacgtcgaccgtaccggttccggggtacccgaccggacgggtacccgtaccggggaacgggggtaacgggtaccgtagggtaacttacggttcggtaaccgttacggtaaggtttaaagtaacggtaaaggttaagtacggtaagtaaaacttaaacgtaatttaatttaaacgtttacgtaacgtaaccttaaacgtccgtttaagggaacgggtaaagggtaccttaagtaccgttaacccaccgtaccttaccggtacggtaaacggtaactaaccgttaaccgaacgtaacgtaccgtagttagttaaccttcgttaaagaaccgggttggaacctaggtaccgtaggtacgtacggtacgtacgggacgtaccggacggtatttaaaccgttagttacggtttaacgggngggttacggaaagggcgggtaacggggttagtaacggttagggtacgggttaggggttacggggtcggggaccggtaacgggg

SEQ ID NO: 267854 - DNA, 901 bp, Homo sapiens
  misc_feature: GYAE6OF01CHHBS.28.57.F02.1.454.CMB.1.raw
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagagtacgctatcacgaccggtgctcgatttagctcgatatagttgggtctgggagaggagcccccgccctgggtttcccaggtgttctcatttggtgatcagcactgcacacgagaagagtcatgacggtaggtttgggctggagtcgttgggttttccttgttgtcgtttaagtttttaaaggtcgtcctagtggtggngggttgacgngtcggttgggtagggtaggttcggtggggggtaggtcgttcggtccgacggtccggggtcgggggtccgtggtacgtccgttctccgtgtacgccgacgtccgtcgtcggtacttcctaccgttacgttagttatttagtcgtctacgtcgtaccgtcgggtccggtcccggaccgtacggtcccgttacgggaacggggtaaacgggtacggtaacggtaagttacgtacggtaccgttaacggtaaggtttaagttaaaccgtaaaggtttagtaacggtaaagttaaaacggtaaattaaacgtttaaagtttaacgtttaacgtaaccgtaaaacgttaaacccgttacggttaaggtaaaccgggggtaaacgggacttaacgttaacgttaacccgtaaccttaccggttaaccggtaaacccggaacggttaaaaacccgttaacgtaaacccggtaaacgtaacccgtaaacccggttgttaaccgtacgttttaacccgaaaggttaaccgtgaacccggttgtaaccgggtcggaaaccgtggttacgtacggaaccggtcggtaaccgtgttaacgtaaagttccggtaggtaacggggtgggaacggtagggacgtaaaacggggtttacgaggggttaagggttaaccggggtgggtaccggggtcgtaccgggg

SEQ ID NO: 267855 - DNA, 996 bp, Homo sapiens
  misc_feature: GYAE6OF01BDU56.28.57.F02.1.454.CMB.1.raw
tcagagtacgctatcacgaccggtgctcgatttagctcgatatagttgggtctgggagaggacgcccccgcccgttgggtttccccaggttgttcctctagtttggtgatcgacgcactgcacgaacagaacgagtcagtgtaccggtaggtttcgggactggtacggtcggttttcgggtttttccttcgtttagttacgttttaagttttttaaacggtcgtaccgtaggtggtaggtacggttcgcgtggtcgttgggtaggtacggttacggggtgggggtaccgttcgttacggcccgacgggtcccggggtttccgggggtacctaggtacccgttaccgtccgttaccgtggtacccgtaccgtcggaccttcgttacggttaccttacccgttaaccgttacgtaacgtttacgttttaacgtacggtacttaacgttccgacccttacggggttcccggtccccggtaccggtaccggttacccgtaaccggggggtagggtaaaaccgggggttccggttaaggttaaacgttaccgttaccggttaccgtaaacggttttaaagggtttaaaaccgttaaagggttaaaaccgggttacgtagtaaaaccgggttaaataaacggtttaaaccttaagtttaacttacgtaaaacccgtacttaaacccggttagtaacgggtaacggtaaaccggtacgtttaacgttaaccgtaaccgttacccgttacgaccccgtaaaggtaacccgtaacgttaaccgtaacgaaactaccgtacggttactacgtttacttaaccgaagtcgtaacggtacacgtacgacggtaacgtgtacggaacgaccgggttacacggtttcgttaacggttacggtactttaaggggcggtaggggtaaacggacgggttacggttaacgggttaggttaaaccggggtaacgggttttcggggacgggttacccggggacggttaccccgggg

SEQ ID NO: 267856 - DNA, 1007 bp, Homo sapiens
  misc_feature: GYAE6OF01AR4P2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtaggtttgggctgacgtcgttgggttttccttgttgtcgttaagtttttaaaggtcgtcctaaggttgtcggaggtgcgtaggcgtgggttacgggtaaggttcggtacgggggtacggtcggtttacgggtacccgtacgggtacccggggttaccggggggtttacccctagggtaaccgttaacccgttcccggttttcccggttacgggttacggacccgttaaccggttccccgtttaccgggttaacggtttacctttacccgttaacccgtttaccggtaaaggtttttaactttacgtacgttaaccggttacgttacggtcccggtaaccgggttccgggtacccgacccgggtacgggtacccggttaacggggaaacgggggtacggtaacggtacgttaaagtccggttagttaaccgttaacgggttaaggttaaacggttaaagtaaacgttaacggtaccgttaaaacggtaaaaccttaaggtaaactttaagtttacgtaaaccgtaactaaacgttaaaccgtcggttaacggtaacggaaaggttacgtaaccggttaacctacccgtaacgttacggtaacccgtacggtaaaccgtaaaccgtaacctaaacccggtaaacaccgtaaccgtttacggtaacttaacggttaacttaaacggtacgtaacgggtaccgtaccggttaacgtacggtacacgggttaccgaaggtaaccccggtagtacggttacccttagaaggtttaacggtcgggttaaacgggtagggtacggtaaccgggtaagggtaaacggttacggttaaaggggtacccgtttagggggaccgggttaacggaccggggttaacggg

SEQ ID NO: 267857 - DNA, 838 bp, Homo sapiens
  misc_feature: GYAE6OF01BAN40.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtcctagtgtgaggtgcgagtcgtgggtggtaggtcggtgggggacgtcgttcggtccacggtccggttggggggtccctaggacgtaccgttccgttccgtgtcgacctacggtcccgttcgtggtactttaccctacctttacgtagttacttttaagtggtacttagtcgtaccgtaccggttcggggtccccgaccggtacggtccgtaccgggaacgggggtaacgggtaaccgtagggtaaactttgttcgttaccgtagtaagttaagttaaggtaaacgtagtacgtaacgtaaataactaattaattacttagtaacgtactaaacgttcgtaaggtaggaacgggtactaaggttacctacgaaccccgtgttacccgtaaccggaacggtaaaccttaaccgtaacccgtaaacggaacccgttaccgtagtttacgttacgtttaaccgtaacgtaagggttacggactacgtccgtaggtaacgaccgttgaacgggtaggaccgtaggttaacgttaggttaacgttaacgtttgggtaacgggttaggggaagggtaagggttacgggtaaccggttaaagggtttaccgggtaaggggttacggggtttagggacccgggggtacgggttaaacccggggg

SEQ ID NO: 267858 - DNA, 886 bp, Homo sapiens
  misc_feature: GYAE6OF01E0326.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatcggacggtagtttgggctgagcgttgggttttccttgttgtcgttaagtttttaaacggtgtaccagttgtcggaggtcgccagtcgtgggtggtacgtcggtgggggcgtcgttcggtccacggtccggtcggggggtccctggacgtcctcctccgtggtcgcctacggcctcgttacggtacttcctacctttcgtaacgttactttaagtcgtacctaactcggtaccgtacccggttacgggcccgtacgacggtaccgtaccggaaggggtaacggtcgtaagggtaacttacgtcgttaccggtacgttaaacgggttaacgtaaggtaaaaggttacgtaacggtaacctaaaacttaaacccgtaatttaagtttaaccgtttacgtaaacccggtaacctttaaaaccgttccggtttaaggggaacggtaaccgggtaacgttaaccctaccgttaacccctaacccgtccgtttaacccgaacggttaaccgtaacccgttaaacctaacccggaaaaccgtcccgaacggtttaccttaacggttaacccttacgttaacggtaacggtaccgggtacctacgggttacaacggtacgggtaacgtcgtaagggaaccgtaccgtaggttcctaaggttacgtaacgttcggggtaggtaggtaacgggtaaacgggtaggaacgggtttaacgggtaaccggggtaacgggtttaggggacccggggtagggtcccggggtaccgg

SEQ ID NO: 267859 - DNA, 698 bp, Homo sapiens
  misc_feature: GYAE6OF01EMPL5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtggaggtgcagctggtggagtcgtgggggagtcttggtccagtccgtggggggtccctgacgactctcctgtcgcacgtcctcgtggtattcctaccttactagttatttagtcgtcttatgccacgtcgggtacccgctacggcctaccggaggggaagggactaggaatactgtctagtaggttataggaagtatagacgaataacataatattatacgactaacgtctaggtacggaaggtactagtacttaccaacctatacccgtacggaacggtaacctaacgttacccaaacgtaaccgacgttacttaggttacttaccgtttaacaaagggtcgggtaacctaggtacccgtaggaaacggtcgtaacgtagggaacggtaccgaacggtcgtaaggttaacttacgtttacggtggggtaaggggaggtacggggtaagtaacgggttaaggtttcggggtaaacggtttagggggttcgggtaacgggggccggtaaccgggg

SEQ ID NO: 267860 - DNA, 875 bp, Homo sapiens
  misc_feature: GYAE6OF01DZLVX.28.57.F02.1.454.CMB.1.raw
tcagagtacgctatcacgaccggtgctcgatttagctcgatatagttgggtctgggagaggagcccccgcccttgggtttcccaggtgttctcatttggtgatcagcactgcacacagaagagtcatgacggtagtttgggctgagtcgttgggtttttcctttggttgtctttaagttttttaaagggtcgtccgagttggttggtagggtgcaggtcgttgggtggtaggttcggtggggggacggtcgttcggtccgacggtcccgggttcggggggttcccctaggacgtccctttcccgtccgttggtcgacccgtaccggtccccttacggttggttaaacccttttcccgtaaccccgttttcggtttaaaggttttactttttacgttacgttaccgttaagttccggacccgttaccgggttccggggtcccccgacccgtaccggggtcccgtacccggggaaagggggtaaccgggtagtaacgggtaattggttcgttaaccgtacgggtaagttaaagtaaaggtaagttaaacgtcggaaaacgttaaaattaactaaagtaatttaacttaacgcggtaaacctacgtacggtaggtaggaacgacgtagtaacctaccgtacctaccgttaccgtaaccgtaacggaacttaacgtaaccaaacggtactaccgtacttagttacttacgttaacgtaacggtcgactacggtaccgtagggaacgtcggtaagtacgggaaccggacgtaccgtattagtactttaggtcggtaagggtagggtaagggagggacggtaaggttacgggttaacggttacggggttgggttacgggtcggggacgggttaccccgggg

SEQ ID NO: 267861 - DNA, 690 bp, Homo sapiens
  misc_feature: GYAE6OF01BWJIK.28.57.F02.1.454.CMB.1.raw
  modified_base (458)..(458): a, c, t, g, unknown or other
  misc_feature (458)..(458): n is a, c, g, or t
tcagagtacgctatcacgaccggtgctcgatttagctcgatatagttgggtctgggagaggagcccccgccctgggtttcccaggtgttctctatttggtgatcagcactgcacacagaagagtcatgacggtagtttgggctgagcgttgggttttccttgttgtcttaatttttaaaggtgtcctagtgtgaggtgcagcgtggtggagtcgtgggggagcgttggtccagccggtgggggtccctgagctcctcctgtgcgagtcctcgtggtattccggtaccttactagttatttatgcttagcgacctcgtcggtccgaccgaggtcctaccggaagggtaacggacgtaggtaactagtcgttcgtacgtaggttaagtaagtaagtaagtagaacgtaaataaagtattaagttacttaagtacgaactaacgtcgttaggtaggaacgngtagtactactaccctatccgtaccggacggtaactaacgttaacgaaacgaacgactaccgttagttaacgttacgttaactaacggtacggacgaacgtacgtagaaggtacgaggtacgacggacgtacggtcgtagttacgtagttacggtgggtaggagggtaaggtacggaacggttaaggttacgggtaacggttaggggttacgggtgggtaccggtaccgggg

SEQ ID NO: 267862 - DNA, 800 bp, Homo sapiens
  misc_feature: GYAE6OF01CBB5H.28.57.F02.1.454.CMB.1.raw
  modified_base (269)..(269): a, c, t, g, unknown or other
  misc_feature (269)..(269): n is a, c, g, or t
  modified_base (508)..(508): a, c, t, g, unknown or other
  misc_feature (508)..(508): n is a, c, g, or t
  modified_base (543)..(543): a, c, t, g, unknown or other
  misc_feature (543)..(543): n is a, c, g, or t
  modified_base (720)..(720): a, c, t, g, unknown or other
  misc_feature (720)..(720): n is a, c, g, or t
tcagagtacgctatcacgaccggtgctcgatttagctcgatatagttgggtctgggagaggacgccccccgcccttgggtttccccgaggtgttctctatttggtgatcagcactggcaacgagaagagagtcagtacggaggtaggtttcgggctggcggtcgtttcgggttttccttgttgtacttttaagttttaaaggtctcgtagtgtaggacgtgacaggtggtgggtaggtcggtcgggtagggggctcggttacgtccggnggtccgggttcggggtacctaggaactccgttccgtacggtctcggtaccgtacgtcgtacggttacgtacttacctaccgttatagtttatgtcgtactagtcgtcggtacggttaccggaccgtcgacggttaccgaacggaacggtacggtaagtacgtagtacgtgttaccgttagtaaggtagtaaaacgttaggtaactagtaaccgtaaataactaaggttaattaggttanaacgtaactacgtttagaacgggtaaggaaaccgngttaaccgtacgtaaccgtagtaaccgtacgtaacgtacggtaaacctacgtaaaccgaacgtacgtacgttacgtacgtataaccgtacgtaacggactacgtacgtcgtagaacggtacgtacgtacggaacgtacgttacggaagttacgtaaccgttaggtagggtaaacggngggaaaccggttaagggacggttaagttaagggtacggttaaaggggttcgggtaacggtgggggacccggttaaccggg

SEQ ID NO: 267863 - DNA, 794 bp, Homo sapiens
  misc_feature: GYAE6OF01DEYAI.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttggtctgggagaggacgcccccgccctgggtttcccaggtgttctctatttggtgatcagcactgcacacagaagagtcatgacggtagttggctgagtcgttggttttcttgttcgtacttaagttttaaaggtcgtccaggtgtaggtaggtgcgagtgtggtggtagttcggtaggggtcgtcgttacggtcgacggtccggtaccgggggtccctgacgtctctcgtgtcgcgacgtcctcgtacgtnttaccctacctctaagttacgttagtactacgtagttacgcgtaccggtcggtacccgccggtacggtccgtaaccggggtaaggtaacgggtaagtacgtaattagttacgtacgtaacgttaggttaaacttagggtaagttaacgtacggtaactaaaacgtaattaattactttaaagttagtacgtaaacgtacgttacgtaaggtaaaccggtagtaacgtaagttaccttaccgacctataccgaacggtacggtaacctaacgttaaccgaacggtaacctcgtacttaagtaccttaacgttacgaaggtaccgaaggtaacgtaaccggtacgataccgggtataaccggacgaacggttcggaaattggtaacgttaacggtcggtagggtaacgggaacgggtaagggttacggtaacgggtttaggggtaaacggttaacggggttaaggggtaacccggtcgggggtaacgggtaacccggg

SEQ ID NO: 267864 - DNA, 862 bp, Homo sapiens
  misc_feature: GYAE6OF01B2TDN.28.57.F02.1.454.CMB.1.raw
tcagagtacgctatcacgaccggtgctcgatttagctcgatatagttgggtctgggagaggacgcccccgccctgggtttcccaggtgttctctagtttggtgatcagcactgcacacagaagacgtcagtcggacgggtaggtttgggctaggtagtcgttcgggttttcctttggttcgtacgtttaagtttttaaaggtcgtaccgtaggtgtaggacggtgcgaggtcgtgggtggaggttcggtgggggacgtcgttggtccgacggtccgggttcgggggtccctaggtaacgtacctccgtccgtggtcgcgtcgtcctacgtggtactaccgtaccttagtattattagtcgtacttatcgcgtaccggtcggtacccgcgacgacgtacggaacggtaacgtgtacgtaacgtcgtcgtacgtacgtaagtaacgtaagaagttagacggtaaactaacttaagtaattaaacggtataacgtagtaaccgttaaccgttggtaacggtagggaaacgtgtaacgtactacctaccgtaacgtaccggaacggttaacggaaactttacgaaacccgtaaacgtaacgtacgttaccgtaagttacgttaaccctaaacggtaacggtccgtaacgtacccggttaacgaacggttacggaaccggtaccggtaggtaacccggacgttaacccgggtgtttaaaccggttaaaggttaccttaacgggggtccgggtaaagggttacgggaaacggttaacgggggtaaacccgggtttaaaggtttacggggtaaaacccggggtttggggttaaccgggggccccggggtttaaaaggtacccccggggg

SEQ ID NO: 267865 - DNA, 1157 bp, Homo sapiens
  misc_feature: GYAE6OF01A82K5.28.57.F02.1.454.CMB.1.raw
  modified_base (1026)..(1026): a, c, t, g, unknown or other
  misc_feature (1026)..(1026): n is a, c, g, or t
tcagagtacgctatcacgaccggtgctcgatttagctcgatatagttgggtctgggagaggagcccccgcccttgggtttcccaggtgttctctatttggtgatcagcactgcacacagaagagtcatgacggtaggtttgggctgaggtcgttcggggtttttcctttggtttgtacttttaaagttttttaaaagggtcgttaccgtaggttggtggtagggttcggacgtaggtcggttgggggtgggtagggttcggggtggggggggaaggttccggtttcgggtcccgtacgggtccccggggttcgggggggttaccccttagggacgtacccgttccgttcccgttgggtcgaccgacgttccccgttcggttacggttaacctttaccctacccgttttaacgttaagttttaatttttacggtacgttaaccttacgttacggtaccccggttaccggggttccccggggggtacccccggtacccgggtaccggggttaccccggtaacccgggggtaaaggggggtaaacggggttaaccggttaagggtaaagtttaacggtttccggtttaccggttaacgggttaaacgggtttaaaggtttaaaacggttaaaacgggttaacggtaacggtaaaaccggttaaaagttaaaacttaaatttaaagtttaaacctttaagtaaccgtaaaccgttaaacgtttcggttaaggggtaaacgggtaaacgggtacttaaacggttacccttaaccccaaaccgtttaccgttaacccgtaaccggggttaaacggtaaaacctaaccgttaaaacccggtaaaccgaaaccgttacccggttatttaccgtttaaactttaaccccgggtaaacggtttaaagggtcccgggacgttaacccggtaacgggtacgggtaaccgggtaagtaccggggtaacgggtaaccgggtaaccgggttaccgttaaccgttttagggtttaaaacccgttttaggtttaaccgggggnggggttaaacgggggaaggttaaggggggtaaacccggggtaggggtttaaaacggtttaaacgggggtagggggggttttaagggggtaccccgggggtaggggggttaaacccgggtaaaccccggggg

SEQ ID NO: 267866 - DNA, 803 bp, Homo sapiens
  misc_feature: GYAE6OF01E1VK3.28.57.F02.1.454.CMB.1.raw
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
tcagagtacgctatcacgaccggtgctcgatttagctcgatatagttgggtctgggagaggacgcccccgccctgggtttcccaggtgttctcatttggtgatcagcactgcacacagaagatcatgacggtagtttgggctgagcgttcgggttttaccgttgttagtcttaagtttttaaaggtgtactaggtagtcggaggtcgacagcgttaggngggtagtcggtagggggngtcgttcgggtcgacggtcccgggttgggggtaccctaggacggtacctcgtccgtgtcgacgtcggtacctcgtaggttactaccgtaacctttcgtagtttaattaacgtccgtacgtaagttgaccccgtacgggttacccggtacccggccgtaaccgggtacggttacccggaaaggggtaacggtacctagggttaattacgtcgttagtacgttaaagttaagttaagtaacgaatagtaacggtaaactaatagtacttaataggaccaactacgtacttaggacgaaggtacctagtactaccaactacgtacgtaccgtaacgaagtaacgaacgtaacgaacgtacgttcgtataccgtactacggtaatacggaacgtacgtaggtaccggtagtaacccggtagtaacgggtaacgtaacggtaacggttaacgtagtttaaaagtaaccggtttacggtacgggtagggtaaggtaaacgtacgggttaaacggttaaacgggtaaggttaacgggttacggggttaacgggaccggggtaagtaaccgggg

SEQ ID NO: 267867 - DNA, 890 bp, Homo sapiens
  misc_feature: GYAE6OF01BLSAI.28.57.F02.1.454.CMB.1.raw
  modified_base (122)..(122): a, c, t, g, unknown or other
  misc_feature (122)..(122): n is a, c, g, or t
tcagagtacgctatcacgaccggtgctcgatttagctcgatatagttgggtctgggagaggagcccccgccctgggtttcccaggtgttctctatttggtgatcagcactgcacacagaagngtcagtgacggtaggtttgggctggagtcgttgggttttccttggttgtactttaagtttttaaggctccgtagtggtgaggtcgcgagtcgtagggtggtacggtcgggtgggggtagttcggttacgggccggtacggtcccggggttccggggggtaccctaggtaaacgttaacgttccgttccggtggtcgaccgttacggttacccgttcgttacgggtacctttacccgtaacccgttttaagtaaaggtttttatttaacgttaccgggtatttaacgtccggtaacccggtacggggttcccgggtacccgtaccggtacggtaccgttaaccgggaaagggggaaccggttagtaaggttacgtacgttcgtacgtacggtaagttaagtaacggaaagttgaacgtaactaaagtaataagttaactaggtttacaacgtaaccttaagtcggttacggaacgggtaagtaccgatttaaccgtacccaaactaccgtaccggttaaaccggaacgttaaccgtaaccttaaaccggaaacggtactaccggttaacgttaacgttaactaccggttaagttaacggacggtacgtacgtacgagtaggccggtaaggacgacgggaacccgtaggtacgttaggttaagtaccggttaagggacgggttagggaagggacggttaacgggtaaggttaaaggggttcccggttaaaggggttcccgggttggggcccggggttaaacgggtccggg

SEQ ID NO: 267868 - DNA, 836 bp, Homo sapiens
  misc_feature: GYAE6OF01A4W0W.28.57.F02.1.454.CMB.1.raw
  modified_base (180)..(180): a, c, t, g, unknown or other
  misc_feature (180)..(180): n is a, c, g, or t
  modified_base (197)..(197): a, c, t, g, unknown or other
  misc_feature (197)..(197): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcaatgacggagtttgggctgagtcttgggttttcctgttgacttaagtttttaaggngtaccagtgtggaggtncgagcgtagggtggagtccggtgggggacgtccgttggtccgacggccggttggggggacccttggaacgtcctcctaccgttggtagccgtacggtccggtacttacgggtacttccgtaaccgtttcgtaaggtttaactttggtgtacctagtacgtaccgtaaccggtcgggtaccccacgggtaccggtaccgtaaccgggaacggggtaacggtaccgtaagggtaactgtcgtactaacggtaggttaattaagtaacgtagtacggtaactaaaacgtacgtaaatttaagtaactttaaggtaccaaacgtttaacgtccgttaagggttaaggaaaccggggtactaacggttaaccttaacccggaaccttaccgttacccggtaccggtaaacgggtaacctttaaccgtaacccgtaaaacgtaaccggtacgttaacgttagggtaaaccttccggttaaacgaagggttcgaacgacccgtacggtaggaacgtaccgttaacggacggtaaggtacccgacggttacctagttaaacgtcgttaggtaggacggggtaaggacgggtaaggtacggtaacgtaagggttacgggtacggtttaggggccggtcgggaacccgg

SEQ ID NO: 267869 - DNA, 851 bp, Homo sapiens
  misc_feature: GYAE6OF01DP1NM.28.57.F02.1.454.CMB.1.raw
  modified_base (199)..(199): a, c, t, g, unknown or other
  misc_feature (199)..(199): n is a, c, g, or t
  modified_base (780)..(780): a, c, t, g, unknown or other
  misc_feature (780)..(780): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtcgttgggtttttccttgttgtcttaatttttaaaggtgtccagtgtagaggtncagcgttggtcggagtcggtgggggacgtcgttggtccgaggtccggtcgggggtcctagacgtctctctgtgcacgtcctgtgtacttcctacgttcgtaagttatttagtacgtatacgtcgacgtaccggtccgggcccgaccgtcggtaccgtaacgggaacggggtaaacggtacgttaggtaaagttcggttacgttagttaacggtaaggtttaaagttaaaggtaaagttaacggtaacgtaaacgtaaaaacgtttaaactaagttttaacttaaagttaaccgtaacggtaaaccctttaaacgttcggttaaacgggtaaacgggaaccgggtaacttaaccgttaaccgtttaaccccgaacccgtttaaccgggtaccccggtaaaaccgggttaaacggttaaacccctttaaaaacggtaaccccggtaaaacgtaaccccgtttaacgtttaacccgttaagtttaaccgttaaaaccggtttaacggtaacgggaccgggtctaaaccggtgtaacggacgtacgtcggtaacggaggtcctagttaacgttagtacgtttagngggtaagtgggaaggtacggaagttaggtaacggtcggttaagggtcggtaacgggccggtaaggacccgg

SEQ ID NO: 267870 - DNA, 831 bp, Homo sapiens
  misc_feature: GYAE6OF01AHYA4.28.57.F02.1.454.CMB.1.raw
  modified_base (464)..(464): a, c, t, g, unknown or other
  misc_feature (464)..(464): n is a, c, g, or t
  modified_base (506)..(506): a, c, t, g, unknown or other
  misc_feature (506)..(506): n is a, c, g, or t
  modified_base (574)..(574): a, c, t, g, unknown or other
  misc_feature (574)..(574): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttggttttccttgttgcttagtttttaaggtgtccagtgtgacggtgacagcgtgggtcggagtcggtgggggagtcgttggccgaggtccgggtcgggggttccctggacgtaccgttcctccgttggtcgccgacggttccgtcgttaggttaccttccgtacccgtttgtaacggttttatttcgtcgtactagtcggcgtacggttcgggccctacggacgtccgtacggaagggtacggactaggaattcgtagtccgtgtaagttagtaaacgtagttaactcgtaacgaaacttaatagttaatagttanactacaacgtttgacgtaaggacgtactaagtctaaccgtanacgttacgacgaaacggttaaccaacttaaaccgagtaacccgtctagggtttaactaacccttttanaacccggtaagggttacccggacgtttaaacccgcggtttacggaacggggttaccgtaacccgttaggggaaaccccgggtttaagaaacccggtttccggttttaattaaaacgttttaccgggttccgggtaaagggggtacccggggttaaaggacccgggtttaagtaaaaaggggttacccgttttaaaccgggggtagggtttaacccggggggtttggggaaacccgggtccgggtaaaaccccggggg

SEQ ID NO: 267871 - DNA, 848 bp, Homo sapiens
  misc_feature: GYAE6OF01EB3AO.28.57.F02.1.454.CMB.1.raw
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagctgggttttccttgttgctatttttaaaggtgttccagtgtgaggtgcagctgggtggagtcgtgggggaggtcgttcgggtcccaaggtcccggtcgggggggtccctaggactacctcgtcccgtgtaggcctacgccttcgtaggtacttccaccttcgtagttatttaatgacttatcgactacgtcgggttcccgaccgacggccgtaccggaggggaacggtagtaccggtaatacgtgtaccagtaaggtaagttaagaagtaagtcgacgtaagtaacaattataattanacgtaactaaacgtcgtaggtaacggtacggaactagttaaccgtttacgtaacccgtaacgtacccgttaaccggtaaacgggtaaacgtaaaccgtttaaaccgaaaccggtaaaccgtaaccgttaccggttaacttaacgttacccggtttaaactaacggggttaccggacgtaaaccgtcccggtaagggtaacgtacgtaaccggtacgggttaaccgaaccgggtacccgttaacggttaacggttttaaccgtaaaccggtttacgggtaaggttaacgggggtaagggtaaacggggttaaacggggtaccgggtttaaaaggttacccggggttaaaaacggggttttagggggttaaaccggggttcgggggttaacccggggtaaacccggggg

SEQ ID NO: 267872 - DNA, 724 bp, Homo sapiens
  misc_feature: GYAE6OF01EKU1R.28.57.F02.1.454.CMB.1.raw
  modified_base (179)..(179): a, c, t, g, unknown or other
  misc_feature (179)..(179): n is a, c, g, or t
  modified_base (187)..(187): a, c, t, g, unknown or other
  misc_feature (187)..(187): n is a, c, g, or t
  modified_base (194)..(194): a, c, t, g, unknown or other
  misc_feature (194)..(194): n is a, c, g, or t
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcttgggttttccttgttgtcttaattttaaaggngtccagtntgaggtncagctggtggagtcgtgggggaggcttggtcgagccggtcgggggtacccctgacgacttctcctgtcgcagtccctntaggacttccacctttntaacgttatttacgngtactagtcgtaccgaacgttccggggtacccgacgtaccggcttaccggaagggggaacggtacgtaggtaattagtacgtacctagtaaggttaacttaaaggtaacgttaaancggtaaactaaaataacgtaattataaacttaacganaacgttaacncgttaggaacgagggtactaagtaccttacaaccctaagttcccgtaaccgaaagggaacccttaagtaccaaaacggactaccggtactaacgttactacgtaacgtaagtcggcgaacttaccggagacggacgtacgacggtaacggaaccgttcggacgttaataacgttaatacggtagggtacgggaaaggttggaaccggtaggtagttaacgggaaacggttcgggtagggtacgggtaccgtacgggg

SEQ ID NO: 267873 - DNA, 837 bp, Homo sapiens
  misc_feature: GYAE6OF01B7FDE.28.57.F02.1.454.CMB.1.raw
tcagagtacgctatcacgaccggtgctcgatttagctcgatatagttgggtctgggagaggagcccccgccctggtttcccaggtgttctcattggtgatcagcactgcacacagaagagtcatgacggagtttgggctgagcgttggttttccttgttgtcttaatttttaaaggtcgtaccgtagtgtagaggtgcagtcgtggaggagtcgtaggggaggtcgtacggtccaggtcccggtgggggtccctagacgtactccgtccgtcgtcgcgacgcctcgtaggtacttccgtacctttacgtagtttacgtttaagtcgttctaagtcgtccgtacgttaccgggtcccgaccgtaaccggtcctacccgggaaaggggtaaaccgggtaaccggttaaggtaaaccgttacttacgggttaccttaacggtaacggtttaaggtttaaacggaaagtttaacgtacggtaaaccgtaaaacgttaacgttaaattaaacgttaatttagttaaccgaacgttaaaaccgttcggtaaggtaacggaacgggtacgaaggttacctacgtaacccgtacgttaaccgtaccgtaaacggtaaccgtaaccttaaccgaaacgtacccgaagttccgtaacgtttcaaccgtttaacgaaccgttacgaaccgtacgtaaccggacgtaggtaccgagtaacgacggaaccgtacggtaccgttaacgttaagttacgttaacggttgggaacggttagggacggaagggtaacggttaacggtacgggttaaacggtggggtttaccgggaccgggtccggtaaccgggg

SEQ ID NO: 267874 - DNA, 824 bp, Homo sapiens
  misc_feature: GYAE6OF01CWT1S.28.57.F02.1.454.CMB.1.raw
  modified_base (679)..(679): a, c, t, g, unknown or other
  misc_feature (679)..(679): n is a, c, g, or t
  modified_base (716)..(716): a, c, t, g, unknown or other
  misc_feature (716)..(716): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggtttttccttgttgtccttaattttttaaagggtcgtccgtagttgtggaggttgcagcgttgggtggaggttcggtgggggaggtccttgggtcccaggtcccgggttacgggggggtcccctggacgtaccttccgtccgttggttacgccgacggtcccttcgtacggttactttaccgtaccctttcgtaagtttatttactgtacttagcgactacggtcgggtcccgaccggtacggccgtaccggaagggggtaacggacgttagggtaacttagtccgttaccgttagtaagggtttaacgtaaggtaaacgttaagtacggtaaccgtaaaattaaacctaagtttaatttaaacgtttacgacgtaaaccttaaaccgtttggtaacgggtaggaacggggtacctaagttacccgttaacccaaccgtacttacccggtaacgaacgggtaacctaaccggttaaccaacgacgtacgtacgtagttacttacgtaacgtaagtcgggacaaccgttntaacggagtacgtggtaacggacggacgttaacggtntttaaggttattacgtagggttacggggaagggaaggtggggtacgagggtttaaggtaagggtttacgggtacgggggttaggggttaccggggacggtacccgggg

SEQ ID NO: 267875 - DNA, 817 bp, Homo sapiens
  misc_feature: GYAE6OF01ARS2A.28.57.F02.1.454.CMB.1.raw
  modified_base (149)..(149): a, c, t, g, unknown or other
  misc_feature (149)..(149): n is a, c, g, or t
  modified_base (235)..(235): a, c, t, g, unknown or other
  misc_feature (235)..(235): n is a, c, g, or t
  modified_base (761)..(761): a, c, t, g, unknown or other
  misc_feature (761)..(761): n is a, c, g, or t
tcagagtacgctatcacgaccggtgctcgatttagctcgatatagttgggtctgggagaggacgcccccgccctggggtttcccaggtgttctcatttggtgatcagcactgcacacagaagagtcatggaacggtaggtttgggctgngcgttgggttttccttgttgtacttatttttaaaggtcgtcctagtggtggaggtgcagcgtgggtgggacggtcggtaggggggnggtcgttcgggtccgacggtccggggttcgggggggtcccctggacgtacctcctccgtgtcgccgacgtcctcgtggtacttcctaccttacgtaattattttatcgtacttatcggtaccgtacggttccgggtccccggtaccggacgggcccgtaaccggggaaagggggtaacgggacggttaaggtaagttacgttcgttaccgttaaggtaacgggtttaaagttaaagggtaaacggttaacggtaacggaaacttaaaaacttaaactaaatttaatttaaatttacggtaactaacccgttaaacgttcggtttaagggaacgggtaaacgggtactaaacggttacttacccaacccttaacgttacccgtaaccgggtaaaccgtaaccgtaaccgttaaacgaaacgtaaccgtacgtacgttaccgttactacgttaacggtaaggtccggtactacgtacgtaggagtacgcgaggtcgaacgtcggtactagttagtaccttaggtgggnggtaggacgggtagtagtacggttaggtaacgggtgggtcggtagggcggtacggg

SEQ ID NO: 267876 - DNA, 893 bp, Homo sapiens
  misc_feature: GYAE6OF01EX69T.28.57.F02.1.454.CMB.1.raw
  modified_base (776)..(776): a, c, t, g, unknown or other
  misc_feature (776)..(776): n is a, c, g, or t
  modified_base (798)..(798): a, c, t, g, unknown or other
  misc_feature (798)..(798): n is a, c, g, or t
tcagagtacgctatcacgaccggtgctcgatttagctcgatatagttgggtctgggagaggagccccccgcccctgggttccctacgtggttcttctattggttgatcacgacgactagcacaacaagaaggaggttacatagtacgggaggttttagggtcgtcggtaggtcgttcggggttttttccgttttgttgttacctttaagtttttttaaagggtttaacggtccgtacgttaggtcgggtaagttcggaccagtcggttgggtagggtcggtacggtggggggtagggtcgttcgggttcccgacggtccgggttacggggggtccccggtagtaacggtccttccttccggtgtcgcgaccgtccgtaccgttgtacttaccttcccgttaacgttaagttttaacgttttctacggtacttacgtacctaccgggtacggttccccggggcccggtaccgtacgggggtaccccgttaaccgggacgggggggttaaaacgggcgttaaaggtaaaggttttcgtttaaccggttcggttaacgttaaacgggttttaaactaaaggttaaaaccgttggttaaacggaaccgttaaatttaaaaactagtttaacgttaattaacggtaccgtaaaccttaaaaccgtggtttaggaacgggaaggtaacgtacgtacttaacccgacttacgtaccggtaccgtaagaaccgtaagtaccaaacgacctaacgtaacgtcgttaactacgtaactacgggtanacgtacgtacgtacgagtacgngtaacgcggacgtcgtactagttacgtagttacggtagggaacggtggacgacggtaggacgtagggtacgtaaggtcggtacgggtcgtacggg

SEQ ID NO: 267877 - DNA, 830 bp, Homo sapiens
  misc_feature: GYAE6OF01DI614.28.57.F02.1.454.CMB.1.raw
tcagagtacgctatcacgaccggtgctcgatttagctcgatatagttgggtctgggagaggagcccccgccctggtttcccaggtgttctcatttggtgatcagcactgcacacagaagagtcatagacggtagtttgggctgagtcgttggtttttccttgttgtacttttaagtttttaaaggtcgtaccgtaggttagtaggtaggtcgactacggtccgttggggtacgggtacgggttcgggtacggggggacggttccgtttccgggttcccggaacgggttcccggggtttccgggggggttaccccctagggtaaccggttaccctttcccggttcccgttggtcggtaccgtacgttccccgttcgttaacgggttactttacccgttaaccttttacgtaaacggttttaacttttaacgttacgtacgttaacgtaccggtaaccggttaaccggtccggggtacccgttccggaacggttaccggaccgggaaagggtacggtaacggttaagtaacgttataccgtacgtaacgtaagttaacgttaagtaagtaacgacgtaaactaaagtactaagttattaatcgtacgtaactagtacgtagtaagggtactacgtagtaactacaccttacgtacctacggacgtaactaacgtaacgaacgtacgactagttactattacgtaatacggacgacgtacgtacgtaacgagtacgcggtaacgacggtacgtagtacttaagtagtagtcgtagggtaagaggtaggatagggtagttacggaacggtttcgggtaaggcggtcggtacggg

SEQ ID NO: 267878 - DNA, 987 bp, Homo sapiens
  misc_feature: GYAE6OF01BV663.28.57.F02.1.454.CMB.1.raw
  modified_base (130)..(130): a, c, t, g, unknown or other
  misc_feature (130)..(130): n is a, c, g, or t
tcagagtacgctatcacgaccggtgctcgatttagctcgatatagttgggtcgtgggagaggagccccgccctgggtttcccaggtgttctcatttggtggactcagcactgcgacacagaagagtcagngacggagtttgggctgagctgggtttcctgttgctattttaaggcgtcagtgtgacggtcgcagtcgtaggtcggaggtcggtgggggagtcgttcgggccagtccgtggggggtccctggacgtactcctaccgtgtcgacctacggtccttacgttggtactttcctaacccgtttacaacggtttaactttaacggtcggtaaccttaattcggaccgttaaccggttccgggggttccccgaccggtaacggggtcccttaacccggggaagggggtaaaccgggttaccgttaggggtaaaccttaaggttcggttacccgttaacggttaaggttaaacgttaaaggtaacggttaagtacggtaaccgggtaaaataaaccgttaaagtttaagttaacggtttaacgtaaccgtaacctaaaaccgtttcgttaaccggaaagggttaaacggggtaccttaaacggttaacgtttaccccaacggttaaccgtttaaaccggttaccggaaacggggttaaacctttaaaaccgggttaaccccaaaaacggtacccgtttaaaccgttcgttaaaccggtttaacgttaaacccttttaacggtaaaacggttcggggttacctaacccgggtccgttaaagggacgtttaaccggacgtttaacggggaaacccggtttaaccggtggttaacccgtttaaggaaacgttttacgggtacgggttaaccgggtaggggtaacccggggttaaggttaacccggggtaagggttaaaccggtacggggtttaaaacccggggtttggggtccgggggtaacggggggtaacccgggtttaacggggg

SEQ ID NO: 267879 - DNA, 821 bp, Homo sapiens
  misc_feature: GYAE6OF01BNFX3.28.57.F02.1.454.CMB.1.raw
  modified_base (696)..(696): a, c, t, g, unknown or other
  misc_feature (696)..(696): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtaggtttgggctgagtcgttggggttttccctttggttgtcttaagtttttaaaggtgtccaggttgtggagggttgcgaggtcgtggtgggtacgtcggtgggggagtcgtttcgggtcccaggtcccggtggggggttcccctaggaacgcctcgttcctggtacgctacggtccttcgtggtaacttccctaacccgtttccgtagtttaagtttatcgggtacttacggttacgtacccgtacggggtttccggggtaccccgtacgtacccggggtccttaacccggggaacgggggaaacggggtaccggttaggtaaaacgttaccgttggtaccgtttaaccggtaagggtttaagttaaaggtaaaggttaagtacccgtaaggtaaaccttaaatatttaaccgtaaatttaccgaacgtaacgtttaaaccgtgtaggtacggaacgggctaagttaccttaccgacctagtacccgtaacgacgtaaccgtaactaacgtaaacacgacgtcctaggtacttacgtacgaacgtcggacacgtgtaacgcggngtaacggacggtaaggacgtacgtacgttacgtagtacgtttaggtcggtacgggacgtaagggtacggtaacgggttaacgtacgggtaaacgggttggggtacggtacggggtcggtaccggg

SEQ ID NO: 267880 - DNA, 937 bp, Homo sapiens
  misc_feature: GYAE6OF01EQXKU.28.57.F02.1.454.CMB.1.raw
tcagagtacgctatcacgaccggtgctcgatttagctcgatatagttgggtctgggagaggagcccccgcccttgggtttccccaggtgttctcatttggtgatcagcactgcacacagaagagtcatgacggtagtttgggctggacgtcttcgggttttccttgttgtacttaagtttttaaaggtgtacctagttggtgtaggtgacgagtcgtgggtaggtacggttcgggtacgggggtaggtcgtttcgggtcccgaacgggtcccgggttaccgggggggtcccctaggtacggtaccttcccgtccgttacggtcgacctacggtacccctaggttcggtacctttacctacccgtttacgtagtttaattttagtcgtacttaacgtcgtaccgtaccggttaccggtcccggacccggtacggtaccgtaccgggaaggggtaacggtaggtacgtaacgtacgttcgtacttaggtaaacggtttaagtaacgggttaaataacggtaacgtaaacggttaaaactaacggtttaagtttaagtttaagtttaaccgtaccgtaaaaccgttaacgttaacggttaggggaacggttaacgggacttaacggtactaacccgtaactaccgttacgtaccgggaaacgttaaccaaaccgttacaaaaccggtaccgtacgtaacgttacgtttaaacccgttaccgtaaacggttaacggtcccgggtaaacgacccggtaagaccgggtaagtaccgtaaccgggttagggtaaccgtacggttacccggttaagttactttaaacggggttacttaacgggggttcggtaaagggggtaaggccgggttaacgggttaaggttaaacgggtttacggggtagggtttaccggggtacgggtacggggtacccggtaaccgggg

SEQ ID NO: 267881 - DNA, 854 bp, Homo sapiens
  misc_feature: GYAE6OF01C0XCI.28.57.F02.1.454.CMB.1.raw
  modified_base (530)..(530): a, c, t, g, unknown or other
  misc_feature (530)..(530): n is a, c, g, or t
tcagagtacgctatcacgaccggtgctcgatttagctcgatatagttgggtctgggagaggagccccccgcccttgggtttcccaggtgttctcatttggtgatcagcactgcacacagaagagtcagtgacggtagtttgggctgagtcgttgggtttttccttgttagtctttaaagtttttaaaggtcgtacctaggtggttaggagggtgcgagtgttagggtgggtacggtcgggtaggggggagtccgtttacgggtcccgagggcccggggttcggggggttccctagggtactccttccgtccgtgtcgccacgtcccttcggtagtaccttacccttaaccgtttgtaagttttaattttagtacgtacttacgttacgaccgttacccgggttccggggacccgtaccggtacggtaccggaccgggaagggggtaacggtaacgtaggtaattcgttacgtactagtaaggttaataaggtaataacgtgtaaacgtaataacatttaattaacgttanacgtaactaaacgttgtaggtaacggaacgtatacgtaaccttacccgacttaacggtaccgaaccgggttaaagaacccttaaacgtaaacgaaccggtaactacggttaccttaagttacccttaagttaaaccgaaggggttcgaccgtaacgtcggtaagaccgggtacgtaggaaccgggacgtaacggacgtttcttaaaggttcttaaccggttgggtacgggggtaagtaaacggggaacgggtacgggtaaacgtttacgggtttacggggaacggggtttaggggtaccgggtaacggggtccggtaaccgggg

SEQ ID NO: 267882 - DNA, 544 bp, Homo sapiens
  misc_feature: GYAE6OF02HFKTW.28.57.F02.1.454.CMB.1.raw
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgttttcgtgtaggctatttaaagtgtcagtgtgaggtgcagctggtggagtctgggggaggcttggtccagactggggggtccctgagactctcctgtgcagcctctggattcaccttcagtatttatgctatgcacgtgggtccgccaggcctccgagggaagggctggaatatgtctcaggtattagaagtaatgcgaataacataatattatgactaaactctgtagaagggcagtattcacctatctccgaggacaattccaaagacacgctagtactcttacaaagtcgggacagtcctaggagagctggagacacggtntagtattagttacgtggtagggagaggagacggtaagttacggtaacggttagggttcggtcgggacgaggg

SEQ ID NO: 267883 - DNA, 223 bp, Homo sapiens
  misc_feature: GYAE6OF02GTJNQ.28.57.F02.1.454.CMB.1.raw
  modified_base (221)..(223): a, c, t, g, unknown or other
  misc_feature (221)..(223): n is a, c, g, or t
tcagagtacgctatcacgaccggtgctcgatttagctcgatatagttgggttgtggggccagggagccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnn

SEQ ID NO: 267884 - DNA, 536 bp, Homo sapiens
  misc_feature: GYAE6OF02IRQ6H.28.57.F02.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattttangctatgcactgggtccnccaggctccgaggggaagggactggaatatgtctcaggtattagaagtaatgacgaataacatatattatgacaaactctgtgaagggcagattcaccatctccaggacaattccaagaacacgctgtatcttacaaatgggcagcctgagagctgaggacacggctagtatattacgtggtagggagaggaggacggtaagttggggaacttagggggttggtcggggacctagggg

SEQ ID NO: 267885 - DNA, 222 bp, Homo sapiens
  misc_feature: GYAE6OF02H63FF.28.57.F02.1.454.CMB.1.raw
  modified_base (220)..(222): a, c, t, g, unknown or other
  misc_feature (220)..(222): n is a, c, g, or t
tcagagtacgctatcacgaccggtgctcgatttagctcgatatagttgggttgtgggccagggagccctggtcaccgtctcctcagcctccaccaagggcccatcggtcttcccctggcgccctgctccaggagcacctccgagagcacagcggccctgggctgcctggtcaaggactacttccatagcgtgctctgagcgggctggcaaggcgcatagnnn

SEQ ID NO: 267886 - DNA, 223 bp, Homo sapiens
  misc_feature: GYAE6OF02HT3ZU.28.57.F02.1.454.CMB.1.raw
  modified_base (221)..(223): a, c, t, g, unknown or other
  misc_feature (221)..(223): n is a, c, g, or t
tcagagtacgctatcacgaccggtgctcgatttagctcgatatagttgggttgtggggccagggagccctggtcaccgtctcctcagcctccaccaagggcccatcggtcttccccctggcgccctgctccaggagcactccgagagcacagcggccctgggctgcctggtcaaggactacttccatagcgtactctgagcgggctggcaaggcgcatagnnn

SEQ ID NO: 267887 - DNA, 224 bp, Homo sapiens
  misc_feature: GYAE6OF02F60FB.28.57.F02.1.454.CMB.1.raw
  modified_base (220)..(224): a, c, t, g, unknown or other
  misc_feature (220)..(224): n is a, c, g, or t
tcagagtacgctatcacgaccggtgctcgatttagctcgatatagttgggttgtgggccagggagccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcatagnnnnn

SEQ ID NO: 267888 - DNA, 515 bp, Homo sapiens
  misc_feature: GYAE6OF02IP5E0.28.57.F02.1.454.CMB.1.raw
  modified_base (278)..(278): a, c, t, g, unknown or other
  misc_feature (278)..(278): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggtttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccgccaggctccagggaaggactggaatatgtctcaggtattagaagtaatgcgaataacatatatatgcaaatctgtgaagggcagattcacatctccaggacaattccaagaacacgctagtatcttacaaatgggcagacctgagagctgaggacaacggctagtatagttactggtgggagaggagcggaattggaacttagggtgtggggccaagggg

SEQ ID NO: 267889 - DNA, 538 bp, Homo sapiens
  misc_feature: GYAE6OF02IO6Z4.28.57.F02.1.454.CMB.1.raw
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccnccaggctccgaggggaagggactggaatatgtctcaggtatagaagtaatgcgaataacatatattatgcaaactctgtgaagggcagattcacatctccaggacaattccaagaacacgctagtatcttacaaatgggcagcctgagagctgaggacacggctagtattagttacgtggtagggagagggagacgggtaagttgggtaacgttaggggttcggtagggggcctaaggggg

SEQ ID NO: 267890 - DNA, 514 bp, Homo sapiens
  misc_feature: GYAE6OF02G9LCV.28.57.F02.1.454.CMB.1.raw
  modified_base (454)..(454): a, c, t, g, unknown or other
  misc_feature (454)..(454): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccgccaggctccagggaagggactggaatatgtctcaggtattagaagtaatgcgaaataacatatattatgcaaactctgtgaagggcagattcacatctcaggacaattccaagacacgctgtatcttcaaatgggcagcctgagagctgaggacacggntgtatatacgtgtgggagaggagcggaattgggaacgttagggttggtggggccgagggg

SEQ ID NO: 267891 - DNA, 522 bp, Homo sapiens
  misc_feature: GYAE6OF02FQSWP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaaggactggaatatgtctcaggtattagaagtaatgacgaataacatatattatgacaaactctgtgaagggcagattcacatctccaggacaattccaagacacgctgtatctacaaatgggcagctgagagctgaggacacggctgtatattacgtggtgggagaggagcggaagttcggaacgttaggggtttggtggggccgtagggg

SEQ ID NO: 267892 - DNA, 529 bp, Homo sapiens
  misc_feature: GYAE6OF02G8OMH.28.57.F02.1.454.CMB.1.raw
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcttgttagctattttaaaggtgtccagtgtgaggtgcagctggtggagtctgggggaggcttggtccagcctggggggtccctgagactctcctgtgcagcctctggattcaccttcagtatttatgctatgcactgggtcccnccaggctccgaggggaaggactggaatatgtctcaggtattagaagtatgacgaataacatatattatgacaaactctagtagaaggcagattcacatctcaggacaatcaagacacgctgtatcttacaaatggcaagcctgagagctgagacacggctagtatattacgtggtagggagaggagacgggtaagttgggaacgttaggggttggtacgggggcctaaggggg

SEQ ID NO: 267893 - DNA, 513 bp, Homo sapiens
  misc_feature: GYAE6OF02GDZPB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaaggactggaatatgtctcaggtattagaagtaatgcgaataacatatattatgacaaactctgtgaagggcagattcacatctcagggacaattccaagaacacgctgtatcttacaaatgggcagcctgagagctgaggacacggctgtatatactgtggagaggagcggaagttggaacgtagggttgtggggctagggg

SEQ ID NO: 267894 - DNA, 644 bp, Homo sapiens
  misc_feature: GYAE6OF02F84I5.28.57.F02.1.454.CMB.1.raw
  modified_base (204)..(204): a, c, t, g, unknown or other
  misc_feature (204)..(204): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggcgtttcggtctaaggcgtactttaaagtggtcagtgtgaggtgcagctggtggagtntggggaggcttggtccgagccgtgggggtcccgtgagactctcctgtgcacgcctcgtgtattctaccttctagttattattgtctagtgtcgtacgtcggtccgccgacggtccgtccggacgggaacgggtacggtaggtaagtagtgtcgtacgtaggttagttaagtaagtaagtagtacgtaataataataattaattatagtactaactacgtagtaggaggacgtagtacttactacctacgtactacgtacggtaacgtaacgtaacgaacgaacgacgtacgtacgttacgttacgttacgtaacgtacggtacgtacgtacgtacgacgtacgtacgtacgacggacgacgtacgtagtattacgttacgtaggtaggtaggaggtaggtaggtaggtaggtaggtagggtagggtacgggtacggacgg

SEQ ID NO: 267895 - DNA, 520 bp, Homo sapiens
  misc_feature: GYAE6OF02HMB5O.28.57.F02.1.454.CMB.1.raw
  modified_base (429)..(429): a, c, t, g, unknown or other
  misc_feature (429)..(429): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggctggaatatgtctcaggtattagaagtaatgcgaataacatatattatgacaaaactctgtgaagggcagattcacatctcagggacaattccaagaacacgctgtatcttanaaatggcagcctgagagctgaggacacggctgtatagttacgtggtagggagaggagcggaagttggaacgtagggttgtggggccagggg

SEQ ID NO: 267896 - DNA, 519 bp, Homo sapiens
  misc_feature: GYAE6OF02GM3AY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaaggactggaatatgtctcaggtattagaagtaatgcgaataacatatattatgacaaactctgtgaagggcagatcacatctcagggacaattccaagaacacgactgtatcttcaatgggacagcctgagagctagaggacacggctagtatattacgtgtagggagaggagcggaagttggaacgttagggtggtgggccgagggg

SEQ ID NO: 267897 - DNA, 533 bp, Homo sapiens
  misc_feature: GYAE6OF02FYKC4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggcctccgagggaagggactggaatatgtctcaggtattagaagtaatgacgaataacatatattatgacaaactctgtagaagggcagattcaccatctccaggacaattaccaagaacacgctgtatcttacaaatgggacagcctgagagctgaggacacggctgtatattacgtggtagggagaggagacggaagttggaacgttaggggttggtggggccgaagggg

SEQ ID NO: 267898 - DNA, 533 bp, Homo sapiens
  misc_feature: GYAE6OF02IEOXC.28.57.F02.1.454.CMB.1.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (361)..(361): a, c, t, g, unknown or other
  misc_feature (361)..(361): n is a, c, g, or t
  modified_base (444)..(444): a, c, t, g, unknown or other
  misc_feature (444)..(444): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttgctatttttaaaggtgtccagtgtgaggtgcagctggtggagtctgggggaggcttggtccagcctggggggtccctgagactctcctgtgcagcctctggattcacctttcagtatttangctatgcactgggtccnccaggctccagggaaggctggaatatgtctcaggtattagaagtaatgacgaataacatatattangacaaactctgtgaagggcagattcacatctccagggacaattccaagaacacgctagtatcttacaaatgggcagcctgagngctgaggacacggctgtatatttacgtggtagggagagggagacggtaagttgggaaacgttaggggttggtgggggacctaacggggg

SEQ ID NO: 267899 - DNA, 526 bp, Homo sapiens
  misc_feature: GYAE6OF02JXX4M.28.57.F02.1.454.CMB.1.raw
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
  modified_base (489)..(489): a, c, t, g, unknown or other
  misc_feature (489)..(489): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcaggtatagaagtaatgacgaataacatatattatgactaaactctgtgaagggcagattcacatcctacaggacaattccaagaacacgntagtatcttanaaagtgggacagcctagagagtcagagacacggctgtatattacgtggtaggagaggngacggattcggaacgttaggggtgtaggggctaaggg

SEQ ID NO: 267900 - DNA, 519 bp, Homo sapiens
  misc_feature: GYAE6OF02H8HES.28.57.F02.1.454.CMB.1.raw
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctatttaaggtgtcagtgtgaggtgcagctggtggagtctgggggaggcttggtccagcctggggggtccctgagactctcctgtgcagcctctggattcacctttcagtatttatgctatgcactgggtccgccaggctccaggggaagggactggaatatgtctcaggtattagaagtaatgcgaataacatatattatgacaaactctgtagaagggcagattcacatctacaggacaagttccaaagacacgctgtatccttnaaatgggacagcctgacgagctgagacnggactggtatattacgtggtcggagaggagaggtattgggaacgttgggtggtaggggacagggg

SEQ ID NO: 267901 - DNA, 536 bp, Homo sapiens
  misc_feature: GYAE6OF02HO8KU.28.57.F02.1.454.CMB.1.raw
  modified_base (297)..(297): a, c, t, g, unknown or other
  misc_feature (297)..(297): n is a, c, g, or t
  modified_base (397)..(397): a, c, t, g, unknown or other
  misc_feature (397)..(397): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgaggggaagggactgggaatatgtctcaggtattagaagtaatgacgaataacatatatatgacaaactctgtagagggcagatcacatcncgaggacaatccaagaacacgctgtatcttacaaagtgggacacgcctgagcgctgaacggacacggctagtatatttacgtggtagggagaaggaggacggtaagttgggaacgttaggggttgtggggacctagggg

SEQ ID NO: 267902 - DNA, 510 bp, Homo sapiens
  misc_feature: GYAE6OF02HYSWU.28.57.F02.1.454.CMB.1.raw
  modified_base (276)..(276): a, c, t, g, unknown or other
  misc_feature (276)..(276): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttgctattttaaaggtgtccagtgtgaggtgcagctggtggagtctgggggaggcttggtccagcctggggggtccctgagactctcctgtgcagcctctggattcaccttcagtatttangctatgcactgggtccgccagggctccgagggaagggctggaatatgtctcaggtattagaagtatgcgaataacatatattatgcaaactctgtagaagggcagattcacatctccaggacaatcaagaacacgctgtatcttacaaatggcagcctagagagctgaggacacggctgtatattacgtggtggagaggagcggagttggaacgtagggtgtgggccgtagggg

SEQ ID NO: 267903 - DNA, 529 bp, Homo sapiens
  misc_feature: GYAE6OF02JHCMW.28.57.F02.1.454.CMB.1.raw
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
  modified_base (413)..(413): a, c, t, g, unknown or other
  misc_feature (413)..(413): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcttgttgctattttaaaggtgtccagtgtgaggtgcagctggtggagtctgggggaggcttggtccagcctggggggtccctgagactctcctgtgcagcctctggattcaccttcagtatttatgctatgcactgggtccncaggctccgagggaaggactggaatatgtctcaggtattagaagtaatgacgaataacatatattangacaaactctagtagaagggcagattcacatctcaggacaattccaagaacncgctagtatcttacaatgggacagacctgagagctagaggacacggntagtatacttacgnggtaggagtaaggagacggtaagttggaacgttaggggtgtacggggacgaaggg

SEQ ID NO: 267904 - DNA, 559 bp, Homo sapiens
  misc_feature: GYAE6OF02I8OSZ.28.57.F02.1.454.CMB.1.raw
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggacccttcaccttcagtattttatgctatgcactgggtccnccaggctccgagggaagggactggaatatgtctcaggtattagaagtaatgacgaataacatatattatgacaaactctagtagaagggcagattcacatctccaggacaattaccaagaacacgctagtactcttacaaagtgggacagcctaggagagctaggaggaccacggtctgtatagttacgtgggtgggaaggagggagacgggtaagttgggaacgttaggggttggtacgggggccgtaacggggg

SEQ ID NO: 267905 - DNA, 537 bp, Homo sapiens
  misc_feature: GYAE6OF02JV36E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgcaggctccgagggaaggactggaatatgtctcaggtattagaagtaatgcgaataacatatattatgacaaactctgtgaagggcagattcacatctaccgaggacaattccaagaacacgctagtatcttacaatgggacagcctgagagctgaggacacggctagtatattacgtggtagggaggaggaggacggtaagttgggaaccgttaggggttggtacgggggacctaaggggg

SEQ ID NO: 267906 - DNA, 529 bp, Homo sapiens
  misc_feature: GYAE6OF02JG7W0.28.57.F02.1.454.CMB.1.raw
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccncaggctccagggagggctggaatatgtctcaggtattagaagtaatgacgaataacatatattatgacaaactctgtgaagggcagattcaccatctcagggacaattccaagacacgctgtatcttacaaatgggacagcctagagacgctgaggacacggctacgtatatacgtggtgggagaggagacgggtaattcgggaacgttaggggttgtcgggggactacgggg

SEQ ID NO: 267907 - DNA, 535 bp, Homo sapiens
  misc_feature: GYAE6OF02ISXC3.28.57.F02.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
  modified_base (449)..(449): a, c, t, g, unknown or other
  misc_feature (449)..(449): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggatgagctgggttttccttgttgctatttttaaaggtgtccagtgtgaggtgcagctggtggagtcgtgggggaggcttggtccagcctggggggtccctgagactctcctgtgcagcctctggattcaccttcagtatttangctatgcactgggtccnccgaggctccgaggggaagggctggaatatgtctnaggtattagaagtatgcgaaataacatatattatgacaaactctgtagaagggcagattcacatctacaggacaagttccaagaacagctagtatcttacaaagtgggacagtccngagagctgaggacacggctagtatattacgnggtagggataagggagtcggtaagttgggaacgttgggtcggtgggcccgagggg

SEQ ID NO: 267908 - DNA, 533 bp, Homo sapiens
  misc_feature: GYAE6OF02GBOW3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactctgtgaagggcagattcacatctccgaggacaattaccaagaacacgctagtatcttacaaatgggacagcctgagagcgtgagacacggctagtatattacgtggtagggaggaggaggacggtaattgggaagttggggttaggtggggcgaagggg

SEQ ID NO: 267909 - DNA, 529 bp, Homo sapiens
  misc_feature: GYAE6OF02G3L4B.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaatctgtgaagggcagattcacatctcaggacaattccaagaacacgctgtatcttacaaatgggcagcctgagagctgaggacacggctagtattattacgtggtaggaggaggagacggaagttgggaacgttaggggttggtggggaccgaagggg

SEQ ID NO: 267910 - DNA, 702 bp, Homo sapiens
  misc_feature: GYAE6OF02IMUZF.28.57.F02.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (565)..(565): a, c, t, g, unknown or other
  misc_feature (565)..(565): n is a, c, g, or t
  modified_base (595)..(595): a, c, t, g, unknown or other
  misc_feature (595)..(595): n is a, c, g, or t
  modified_base (619)..(619): a, c, t, g, unknown or other
  misc_feature (619)..(619): n is a, c, g, or t
tcagagtacgctatcacgaccggtgctcgatttagctcgatatagttgggggtctgggagaaggagcccccgcccgtgggtttcccgaggtgttctacatttggtgtatcagccactgtcactacagaagtagtcatgacggagttttgggctgacgtcgtggggtttttccttggttttgcctattttttaaaggtcgtccctacgtggtgaggttgcctagcgtggtggaggtcctcgggggagcttaggtccagccgttgggggtccctgagtacttctcctgtcgacagcctctaggtattccaccgtttcagtactttaacngctatcgcatcgggtccnccgacggtccttccgtaaggggaggggtacctagggaacgttatcggttccgttccgtaaggttaacttagtaaacgttagttaggaacgtaaagttaacagtaattattatcactaaactctagtagaggcagtattccactatcaccgaggaaactaagttccaaagtaccacgttcttgttactccttacaaacgtgggactacggtccttacgganacggtccttagggacggtaccgtaaccggngttaggttacttaactttaccggnggttaacggggagtaacgggtcggtaaccgggttaagtttaccgggaacgtttagggggttcgttccggggaccggtaacggg

SEQ ID NO: 267911 - DNA, 563 bp, Homo sapiens
  misc_feature: GYAE6OF02G1681.28.57.F02.1.454.CMB.1.raw
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
tcagagtacgctatcacgaccggtgctcgatttagctcgatatagttgggtttgggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtgggagaggagcggaattggaacgtagggttgtggggccagggagcccgtggtcaccgtctcctcacgcctccaccaacgggcccaatccggtccttcccccgtcggccgtccccgtcgcctccgacgggacgccgaccctccgacgacgcgaccgacgccggcccgtgggcctcggcccgtggtaccgaacggtactaccttcccaagttacgccgttactcgtacggacggccgggcgtcgggcgaaggcgacacgtagcngnn

SEQ ID NO: 267912 - DNA, 531 bp, Homo sapiens
  misc_feature: GYAE6OF02JEU15.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactctgtgaagggcagattcacatctccaggacaattccaagaacacgctgtatcttacaaatgggacagcctagagagctgaggacacggctagtatagttacgtggtagggagaggagacggaattgggaacgttagggttggtcggggacctagggg

SEQ ID NO: 267913 - DNA, 551 bp, Homo sapiens
  misc_feature: GYAE6OF02IVYX3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaaggactggaatatgtctcaggtattagaagtaatgacgaataacatatattatgacaaactctgtagaagggcaagtattcaccatcctccagggacaattccaaagaacacgctagtatcttacaaagtgggcaggcctaggagagcgtagaaggacacggctagtactaattacgtggtaggggagtaggaaggaggtaagttggaacgttaggggtttggacgggggcgaacgggg

SEQ ID NO: 267914 - DNA, 519 bp, Homo sapiens
  misc_feature: GYAE6OF02GZCLL.28.57.F02.1.454.CMB.1.raw
  modified_base (488)..(488): a, c, t, g, unknown or other
  misc_feature (488)..(488): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgcgaataacatatattatgacaaactctgtgaagggcagattcaccatctccagggacaattccaagaacacgctgtatcttacaaatgggcagcctgagagctagaggacacggctgtatattacgtgtagggagaggagnggaattggaacgtagggttgtggggcagggg

SEQ ID NO: 267915 - DNA, 525 bp, Homo sapiens
  misc_feature: GYAE6OF02GGZKM.28.57.F02.1.454.CMB.1.raw
  modified_base (429)..(429): a, c, t, g, unknown or other
  misc_feature (429)..(429): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgcgaataacatatattatgacaaactctgtgaagggcagattcacatctccaggacaattccaagaacacgctgtatcttanaaatgggacagcctgagagctagagacacggctgtatattacgtggtagggagaggagcggaagttgggaacgttaggggttgtggggcgtagggg

SEQ ID NO: 267916 - DNA, 541 bp, Homo sapiens
  misc_feature: GYAE6OF02FQLAN.28.57.F02.1.454.CMB.1.raw
  modified_base (297)..(297): a, c, t, g, unknown or other
  misc_feature (297)..(297): n is a, c, g, or t
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaagggactggaatatgtctcaggtattagaagtaatgcgaataacattatattatgacaaactctgtgaagggcagattcacatctccagggacaattccaagaacacgctgtatcttanaaatgggcagcctagagagctgaggacacggctatatagttacgtggtagggaggaggagacgggtaattcggggaaacttagggggtttcgtaggggaccctaaggggg

SEQ ID NO: 267917 - DNA, 549 bp, Homo sapiens
  misc_feature: GYAE6OF02G9KXE.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagttatttatgctatgcacgtgggtccnccaggctccgaggggaagggactggaatatgtctcgaggtattagaagtatgacgaataacataatattatgacaaactctgtagagggcagattcacatctcgaggacaatcaagacacgctgtatctacaaagtggacagcctgagacgctaggaaggacacgggtctagtattattacgtgggtagggagaggaggacggtaagtttcgggaacgttaggggttggtacgggggacgtaacggggg

SEQ ID NO: 267918 - DNA, 545 bp, Homo sapiens
  misc_feature: GYAE6OF02IDKBG.28.57.F02.1.454.CMB.1.raw
  modified_base (369)..(369): a, c, t, g, unknown or other
  misc_feature (369)..(369): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggggaggcttggtccagccgtgggggggtccctgagactctcctgtgcagcctctggattcaccttcagtatttatgctatgcactgggtccgccaggcctccgaggggaggactggaatatgtctcaggtatagaagtatgacgaataacatatattangacaaactctgagaagggcagatcacatctcaggacaatacaagaacacgctgtatcttacaaagngggacagcctgagngctgaggacacggatgtatattacgtggtagggtaggaaggagacgggtaagttacgggaacggttaggggttagggtacggggccgtaacggggg

SEQ ID NO: 267919 - DNA, 562 bp, Homo sapiens
  misc_feature: GYAE6OF02IRN1G.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactgggaatatgtctcaggtattagaagtaatgacgaataacatatattatgacaaactctgtgaagggcagattcacatctcaggacaattccaagacacgctgtatcttacaaagtcgggacagcctgagagctgaaggacacgggctggtatagtttactagggttcgggaggtaacgggaggaccgggtaaagtttacgggaacgttagggggtttgggttcgggggacccgtaacggggg

SEQ ID NO: 267920 - DNA, 520 bp, Homo sapiens
  misc_feature: GYAE6OF02FPH5Z.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgacgaataacatatattatgcaaactctgtgaagggcagattcaccatctcaggacaattccaagacacgctgtatcttacaatggacagcctgagagctagagacacggctgtatattacgtgtgggagaggagacggaagttcggaacgttagggtggtggggcgtacgggg

SEQ ID NO: 267921 - DNA, 787 bp, Homo sapiens
  misc_feature: GYAE6OF02J3W47.28.57.F02.1.454.CMB.1.raw
  modified_base (144)..(144): a, c, t, g, unknown or other
  misc_feature (144)..(144): n is a, c, g, or t
  modified_base (684)..(684): a, c, t, g, unknown or other
  misc_feature (684)..(684): n is a, c, g, or t
tcagagtacgctatcacgaccggtgctcgatttagctcgatatagttgggtctgggagaggacgcccccgccctgggtttcccaggtgttctcatttggtgatcagcactgcacacagagagtcagtggacggtagttggctgngttcgtttcggttttacttgtgtactttaagttttaacggcgtacgtagtggtggacggtcgcgtaggtggtgggtggtacggtcgggtggggtcgtcgttcggccgtcgggtccgggttacggggtccctagtaccgtcctccgtcgtggtccgcgtccggtccttacgtacgttaccttaccgtaccttagtaagtttacttacgtcgttactacggtccgaccgtaccggtccggtacccgacggtacggcggtaaacgggaggggtaacgtacgtaagtaactcgtcgtaacgtaaggttaagttaagaaagtacgttaagacgtaaactaatacttaagttattacgtacgtactaacgtacgtggtacggaacggtactaccgacttaaccgtaccaacgtttaccgaaccgtaaacggtaactaaaccttacccgaaaccgtaagtacccgttagttcgtaaacgttaccgtaacgtaacggcgggtaccaacggctacgggagtaccgaacgttcggaacggttacacggtnttaacgtagttaggtacggagggtaacggagggttaccgtaaggtacgggttaagtaacgggttcgggtaacggggtcggaccgggtaccgagggttaccccg

SEQ ID NO: 267922 - DNA, 568 bp, Homo sapiens
  misc_feature: GYAE6OF02H0MNF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattttatgctatgcactggggtccgccaggctccgaggggagggactggaatatgtctcaggtattagaagtaatgcgaaataacatatattatgacaaactctgtgaagggcagtattcacatctccgaggacaattccaaagaacacgctgtaatccttacaaagtgggacagcctggagagctagacggacacgggtctggtattagttacgtggttagggaggtaaggaaggcgggtaaagtttcggggaaacgtttagggggtttggtacggggggaccctaagggggg

SEQ ID NO: 267923 - DNA, 519 bp, Homo sapiens
  misc_feature: GYAE6OF02FGPO1.28.57.F02.1.454.CMB.1.raw
  modified_base (490)..(490): a, c, t, g, unknown or other
  misc_feature (490)..(490): n is a, c, g, or t
  modified_base (516)..(519): a, c, t, g, unknown or other
  misc_feature (516)..(519): n is a, c, g, or t
tcagagtacgctatcacgaccggtgctcgatttagctcgatatagttgggtttgggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtggagaggagcggaattggaactaggggttgtggggccagggagccctggtcaccgtctcctcagcctccaccaaggggcccagtccggtccttcccccgtggccgcccctcgcctcccgaggacgccacctccgagacgcacagccggccctgggcctgccctggtccaaggacctactccatacgcgtacnctgagcgggctggcaaggcgcatagnnnn

SEQ ID NO: 267924 - DNA, 559 bp, Homo sapiens
  misc_feature: GYAE6OF02H4BMT.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagcctggggggtccctgagactctcctgtgcagcctctggattcaccttcagtatttatgctatgcactgggtccnccaggcctccgagggaagggctggaatatgtctcaggtattagaagtatgacgaataacatatattatgactaaactctagtagaagggcagtattccacctatcctccgagggacaacttaccaaagaacacgctgtactcttacaagtgggacacgtcctagagagctgaggacacggctgtatagttacgtggtagggaggaggaggtacggtaagttacgggtaacgttggggttagggtacggggccgtaacgggg

SEQ ID NO: 267925 - DNA, 606 bp, Homo sapiens
  misc_feature: GYAE6OF02IOQV4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtggtttcgtgtagctattttaaagtgtcagtgtgaggtgcagctggtggagtcgtggggggaggcgttggtccaggccgttgggggggtccctggagactctcctgtgcagcctctggattcaccttcaagttatttatgcttatgcacgtgggtcccgccaggcctccgaggggaagggctagggaatagtgtctcgaggtattagaagtatgagaataacatattattatcgactaaactctagtaggaagggctagattcaacctatctacccgagggaactaacgttaccaacgaacaacgaccttagtaattccttaacgaaagtgggactacggtacctaggacgagacgtaggaacggcgaacggtcttaggtattacgttacgtggttcgggaggaggtacggtaggtaacgttcgggtaagttaggggttggcggggaccgtaacggggg

SEQ ID NO: 267926 - DNA, 579 bp, Homo sapiens
  misc_feature: GYAE6OF02F69Y7.28.57.F02.1.454.CMB.1.raw
  modified_base (245)..(245): a, c, t, g, unknown or other
  misc_feature (245)..(245): n is a, c, g, or t
  modified_base (546)..(546): a, c, t, g, unknown or other
  misc_feature (546)..(546): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagccgtggaggtctggggtagggcgtggttccgacgctcgggggtcccggtcgnggacgtctcctcgtgcgagcctcctggtagttctaccttcctagtatttaattgtctatgcactgggtccggccacggcgtccagggaaggggacgtaggaagtaatgtcgtctaggtattagaagtaatagtcgaataaacataataatttattagacaaactactgtaggaagggacagattcaccaatctaccgacggtacaaacttacaacgaacacgcttagtatacttaccaaatgggcagtcctagagagtctagaggtacacggtctagtattatacgtggtgggagaggagnggtaatggacgtagggttggtgggcggaggcgg

SEQ ID NO: 267927 - DNA, 627 bp, Homo sapiens
  misc_feature: GYAE6OF02FHTJL.28.57.F02.1.454.CMB.1.raw
  modified_base (298)..(298): a, c, t, g, unknown or other
  misc_feature (298)..(298): n is a, c, g, or t
  modified_base (324)..(324): a, c, t, g, unknown or other
  misc_feature (324)..(324): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagcgtgggttttcgtgttgctattttaaaggtgtccagtgtgaggtgcagctggtggagtctgggggagcttggtccagccgtggggggtccctgagactctcctgtgcagcctctggattcaccttcagttattatgctaatgcactgggtccnccaggctccgagggaggactggaatntgtctcaggtattagaagtagtgcgaataacattatattatgacaaactctagttagaagggtacaaggtacttcgaacctagtaccgtaccgaaggggactaaacgttaccaaagaaacctacgacgttagtttaatcctttacaaagttcggggacacggtaccttaggaacgtaagtccttagggaacgtaccgacggtaccttaggtataacgttacggtaggtgggtaaggagggtacggtacgggtaagttacgggaaccggttaggggttacgggtacgggggtactaaccggggg

SEQ ID NO: 267928 - DNA, 548 bp, Homo sapiens
  misc_feature: GYAE6OF02G7AL2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccgccaggcctccgaggggaagggactggaatatgtctcgaggtattagaagtaatgacgaaataacatatattatagacaaactctgtagaagggcagatcacatctcaggacatccaagacacgctgtactcttacaagtgggacagcctagagagctgacggacacggctagtatattacgtggtagggaaggaggaggtaggtaagtttacgggaacggttaggggtttggacgggggaccgaacgggg

SEQ ID NO: 267929 - DNA, 557 bp, Homo sapiens
  misc_feature: GYAE6OF02IVKBW.28.57.F02.1.454.CMB.1.raw
  modified_base (372)..(372): a, c, t, g, unknown or other
  misc_feature (372)..(372): n is a, c, g, or t
  modified_base (402)..(402): a, c, t, g, unknown or other
  misc_feature (402)..(402): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgttagcgtattttaaaggtgtccagtgtgaggtgcagctggtggagtctgggggaggcttggtccagcctggggggtccctgagactctcctgtgcagcctctggattcaccttcagtatttatgctatgcacgtgggtccgccagggcctccgagggaacgggactgggaatagtgtctcgaggtattaagaagtatgacgaataacatatattangactaaactctgtagaagggcagattcacntctcaggactataccaagaacacgctgtactctacaaatggacagcctagagngntagacgacgacggctagtatagttacgtggtacgggaggtagggaaggacggttaagttagggtaacgttacggggttaggtcggggtacgtaacggggg

SEQ ID NO: 267930 - DNA, 546 bp, Homo sapiens
  misc_feature: GYAE6OF02GJXWW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggacgtggaatagtgtctcgaggtattagaagtaatgacgaataacatatattatgacaaactctgtagaagggcagattcacatctcgaggacaattccaagaacacgctgtatcttacaaatgggacagcctgagagctagacggacgacggtctgttatagttacgtggtagggaggaggaggacggtaagttcgggaacgttagggttggtacggggccgtaacgggg

SEQ ID NO: 267931 - DNA, 551 bp, Homo sapiens
  misc_feature: GYAE6OF02GBYKV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccagggcctccgaggggaagggactggaatatgtctcaggtattagaagtaatgacgaataacatatattatgactaaactctaggtagaagggcagattacaccatctcgagggacaattaccaagaacacgctagtatcttacaaagtgggacagcctgagagcgtgaagacgacggctgtatagttacgtggtgggaggaggacgagggtaagttgggaaccgttaggggttaggtcggggccgtacgggg

SEQ ID NO: 267932 - DNA, 676 bp, Homo sapiens
  misc_feature: GYAE6OF02HUIEA.28.57.F02.1.454.CMB.1.raw
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccagccgtggggggtccctgagactctcctgtgcagcctctggattccacctttcagttattttatgtctatgctacgtcgggtcccgccgaggcctccggaagggggaaacggggaccttagggaaattagtggttcctcgtaagggttaatttaaggaaaggttaaatggacggtaaataaacaattaattaatttaatgactaaaacttcgtagtaggaaaggggcaagtacttaccaacctattcctaccgaagggtaacctaaacttacccgaaagaaaccacgacttagtaacttcttaaccaaagttcggggacaaggtccctaggaacgagccgttaggaacgggaaccacgggtcttagttattacttacggtggtaggggaggagggagacgggtaagttgggtaacggttaggggtttgggtacgggggaccgtaacggggg

SEQ ID NO: 267933 - DNA, 524 bp, Homo sapiens
  misc_feature: GYAE6OF02HM0MV.28.57.F02.1.454.CMB.1.raw
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcacctttcagtatttatgctatgcactgggtccgccaggctccgagggaagggactggaatatgtctcaggtattagaagtatgcgaataacatatattatgacaaactctgtgaagggcagatcacatcncaggacaattccaagaacacgctgtatcttacaaatgggacagcctgagagctgaggacacggctgtatattacgtggtgggagaggagacggaattcgggaagttggggttaggtggggccgtaagggg

SEQ ID NO: 267934 - DNA, 536 bp, Homo sapiens
  misc_feature: GYAE6OF02INWG5.28.57.F02.1.454.CMB.1.raw
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagccgtggggggtccctgagactctcctgtgcagcctctggattcaccttcagttatttatgctatgcactgggtccnccaggctccgaggggaggactggaatntgtctcaggtatagaagtatgacgaaataacataatattatagactaaactctagtgaagggcagattcacatctacaggacaatacaagacacgctgtactcttacaagtcgggacagcctagagagcgtgaggacacggctagtatattacgtggtagggagaggagaggtaagttacggaagttaggggttaggtggggacagggg

SEQ ID NO: 267935 - DNA, 561 bp, Homo sapiens
  misc_feature: GYAE6OF02I2AZ3.28.57.F02.1.454.CMB.1.raw
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtccgccgaggcctccgaggggaagggactggaatatgtctcaggtataagaagtaatgacgaataacatatattatgacaaactntgtagaagggcagtatcacatctcaggactaatccaagacacgctagtactcttacaaatgggacagcctagagagctagaaggacaacggtctagtatagttacgtggttagggaagtagggagtacgggtaagtttcgggaaacgttagggggtttacggtagggggaccctaaggggg

SEQ ID NO: 267936 - DNA, 547 bp, Homo sapiens
  misc_feature: GYAE6OF02GOEOK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgagggaagggactggaatatgtctcaggtattaagaagtaatgacgaaataacatatattatgacaaatctgtagaagggcagattcaccatctccgaggacaattaccaagaacacgctagtatcttacaaagtgggacagcctgagagctagacggacacggctagtatattacgtggtagggaggaggaggacggtaagttgggaacgttaggggttggtacggggccgtaacgggg

SEQ ID NO: 267937 - DNA, 541 bp, Homo sapiens
  misc_feature: GYAE6OF02FWW3H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaggactggaatatgtctcaggtattagaagtaatgacgaataacatatattatgacaaactctaggtgaagggcagattcaccatctccagggacaattccaagaacacgctagttactacttacaaagtgggacacgcctgaagacgtctgaaggacacggctgtatagttacgtggtagggagagggagacggaattcgggaagttagggttggtcggggcctagggg

SEQ ID NO: 267938 - DNA, 549 bp, Homo sapiens
  misc_feature: GYAE6OF02I23XW.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccgccaggctccgaggggaagggactggaatatgtctcaggtattagaagtaatgacgaataacataatattatgacaaactctgtagaagggcagattcacatctcaggacattccaagaccacgctagtactcttacaaatgggacagcctgagagctaggaaggcacggctgtatattacgtggtagggagtaggaggacgggtaagtttgggaaacgttagggggttcggtacgggggccgtaacggggg

SEQ ID NO: 267939 - DNA, 531 bp, Homo sapiens
  misc_feature: GYAE6OF02JWMKR.28.57.F02.1.454.CMB.1.raw
  modified_base (496)..(496): a, c, t, g, unknown or other
  misc_feature (496)..(496): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattcaccttcagtatttatgctatgcacgtgggtccgccaggcctccgagggaagggactgggaatatgtctcaggtattagaagtatgcgaataacatatattatgacaaactctagtgaagggcagattcacatctaccagggacaattaccaagaacacgctagtatcttacaaagtcgggcagcctagagagctgaggacgacggctgtatattacgtggtaggagaggagnggaagttggaacgtagggttggtagggcgtagggg

SEQ ID NO: 267940 - DNA, 602 bp, Homo sapiens
  misc_feature: GYAE6OF02HPSX8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattccaccttcagttatttatgctatgcacgtcgggtccgccaggcctccgaggggaaggactaggaatagtgtctcgaggtattagaagtaatgacgaataacataatattatagacaaactctagtagaagggctagattccaacctattcctaccgagggaactaaacttaccaaagaacacgctagtaacttcttaacaaagtcgggacacgtcctagagacgtcgtaggaacggacgacggtcttagttattacgttacgtgggtaggggaagagggacgacgggtaagttacgggaacggtttagggggttcggtacggggacgaacggggg

SEQ ID NO: 267941 - DNA, 527 bp, Homo sapiens
  misc_feature: GYAE6OF02ITL3J.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccncaggctccagggagggactggaatatgtctcaggtattagaagtatgacgaataacatatattatgacaaactctgtagaagggcagattcacatctcaggacaattcaagacacgctagtatcttacaaatgggacagcctgagagctgaggacacggctgtatattacgtggtagggagaggagacggaagttgggaacgttaggggttaggtggggaccgtaagggg

SEQ ID NO: 267942 - DNA, 542 bp, Homo sapiens
  misc_feature: GYAE6OF02IW1S5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattaagaagtaatgacgaataacatatattatgactaaatctgtagaagggcagtattccacatctcgaggacaattccaaagacacgctgtactctacaaatcgggcagcctggagagctgaggacaggctagtattattacgtggtagggagtaggacggacggtaagttcgggaacgttggggtggtacggggcctaaggggg

SEQ ID NO: 267943 - DNA, 521 bp, Homo sapiens
  misc_feature: GYAE6OF02GKQMU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaagggactggaatatgtctcaggtattagagtaatgacgaataacataatattatgactaaactctagtagaagggcagattcaccatctcaggacaatccaagacacgctgtatcttacaaatgggacagcctgagagctgagacacgctgtatattacgtggtgggagaggagcggtaattggaacgtagggttgtggggccgaaggg

SEQ ID NO: 267944 - DNA, 549 bp, Homo sapiens
  misc_feature: GYAE6OF02GNWN6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggcctccgaggggaagggactggaatatgtctcaggtattagaagtaatgacgaataacatatattatgacaaactctagtagaagggcagattcaccatctaccgagggacaattccaaagaacacgctagtatcttacaaatgggacagcctgagagctagaggacacggctagtatagttacgtggtagggaggaggagacggtaagttgggaacgttaggggtcggtacggggccgtaacgggg

SEQ ID NO: 267945 - DNA, 627 bp, Homo sapiens
  misc_feature: GYAE6OF02IDWRM.28.57.F02.1.454.CMB.1.raw
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctntgattcacctttcagtatttatgctatgcactgggtccnccaggcctccgaggggaaggactggaatatgtctcaggtattagaagtaatgacgtaataacattaatatttaangacaaaacttctaggtaggaagggcaggtattaccgaaccatcctaccgaagggacaattacccaaggaacacggcttagtacttcttacaaagtcgggacagccttagagacgtcgtaggaaggaccgaacggtcgtacgttaagtaacttttaccgtgggttacggggaaggtaacgggaacggtacgggtaagtttaacgggtaaaccggtttaggggggtttagggttacggggggacccgtaacgggggg

SEQ ID NO: 267946 - DNA, 779 bp, Homo sapiens
  misc_feature: GYAE6OF02HSZX6.28.57.F02.1.454.CMB.1.raw
tcagagtacgctatcacgaccggtgctcgatttagctcgatatagttgggtctgggagaggggagcccccgccctgggtttcccaggtgttctcagtttggtgatcagcactggcacacagaagagtcatgacggagtttgggctgagcgtggtttcgtcgttaggcctattttaaaggtgtccagtgtgaggtgcagctggtggagtctgggggaggctggtccagcctgggggtccctgacgactctcctgtacgcagcctctggatttcaacctttcaagttattttatgtctatagcactcgggtccgccaacgggccctaccgaggggaacgggactagggtaagtagtggtacctacgaaggtacgttaacggaaagttaaagttacgacgtaaataaactataattaagttactcgactaaacgtcgtagtacgaacgggcctaacgtattacctaaccacttccgtaccgacgggtaacctaacgttaccgaaaggaaaccgacggtaccgttagtaacgtttaccttaacgtaaaacgttcgggacctacggtacccgttaggaagtaacggtaccgttaggtaaacggggtaacctaaaccgggtacgttacgtttaacgttttaacgtttaaccggttcgggtttaaccgggggtaaagggtaaacggggtaacgggtaccggggttaaacggtttaacgggggtaaaaccgttttacggggggtttaacgggtacccggggggggtaacccgtaaaccccggggggg

SEQ ID NO: 267947 - DNA, 533 bp, Homo sapiens
  misc_feature: GYAE6OF02G2BLV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaggactggaatatgtctcaggtattagaagtaatgacgaataacatatattatgacaaactctagtagaagggcagattcacatctccgaggacaattccaagaacacgctgtatcttacaagtgggcagcctagagagctgagacgacggctagtatattacgtggtaggagaggaggcggtaagttagggaacgttaggggttggtaggggccgagggg

SEQ ID NO: 267948 - DNA, 532 bp, Homo sapiens
  misc_feature: GYAE6OF02I9N56.28.57.F02.1.454.CMB.1.raw
  modified_base (462)..(462): a, c, t, g, unknown or other
  misc_feature (462)..(462): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgactaaactctgtagaagggcagattcacatctccaggacaattccaagaacacgctagtatacttacaaatgggacagcctgagagctgaggacncggctgtatattacgtggtagggagaggagcggtaagttgggaacgtagggttggtggggcgtaacgggg

SEQ ID NO: 267949 - DNA, 528 bp, Homo sapiens
  misc_feature: GYAE6OF02I35XJ.28.57.F02.1.454.CMB.1.raw
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccgccaggctccgagggaagggactgggaatatgtctcaggtattagaagtaatgacgaataacataatattatgacaaactctgtgaagggcagattcacatctcaggacaattccaagaacacgctgtatcttacaaatgggcagcctagagagctgaggacacggctgtatattacgtggtagggagaggagcggtaagttgggaacgttggggtggtggggccgtagggg

SEQ ID NO: 267950 - DNA, 574 bp, Homo sapiens
  misc_feature: GYAE6OF02IDLL1.28.57.F02.1.454.CMB.1.raw
  modified_base (259)..(259): a, c, t, g, unknown or other
  misc_feature (259)..(259): n is a, c, g, or t
  modified_base (281)..(281): a, c, t, g, unknown or other
  misc_feature (281)..(281): n is a, c, g, or t
  modified_base (369)..(369): a, c, t, g, unknown or other
  misc_feature (369)..(369): n is a, c, g, or t
  modified_base (437)..(437): a, c, t, g, unknown or other
  misc_feature (437)..(437): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctntggattcaccttcagtatttangctatgcactgggtccgccaggctccgaggggaaggctggaatatgtctcgaggttattagaagtaatgacgtaataacatatattangacaaactctagtgaagggcagattcactatctacagggacaattaccaagacacgctgtatcctaanaaagtcgggacacgcctgaagagcgttagagggtacacgggtctaggtataacgttcgtgggtagggagaggaacggtcgggttaacttaggggtaaacggttacgggggtttggaccgggggtaccgtaacggggg

SEQ ID NO: 267951 - DNA, 599 bp, Homo sapiens
  misc_feature: GYAE6OF02JCZ3A.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtcccgcaggctccgagggagggactggaatatgtctcaggtattagaagtaatgacgaataacatatattatgactaaactctagtgaagggcagtatcaccatctcgaggactaattccaaagacacgctgtacttcttacaaagtcgggacagccgtagaagcgcgtaggaaggaccgacgggtcttagttacttaagtttaccggtgggttacgggggaagtaaggggaacggtaacgggttaagtttacggggaaaccgtttaggggggttgggttacggggggacccgtaacgggggg

SEQ ID NO: 267952 - DNA, 574 bp, Homo sapiens
  misc_feature: GYAE6OF02HDHAL.28.57.F02.1.454.CMB.1.raw
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtcccgccgaggcctccgaggggaagggactggaatatgtctcaggtattagaagtaatgacgaataacatatattatgacaaactctagtagaagggcagattcacatctacaggacaacttaccaagaacacgctagtactcttacaaagtcgggacacgcctaggagacggcgtaggaggaccgacggctaggtattaacgttacgtgggtagggaaggagggacggagggtaagttacgggaacggtttagggggttcggtacggggacgtacggggg

SEQ ID NO: 267953 - DNA, 609 bp, Homo sapiens
  misc_feature: GYAE6OF02ILQ1V.28.57.F02.1.454.CMB.1.raw
  modified_base (282)..(282): a, c, t, g, unknown or other
  misc_feature (282)..(282): n is a, c, g, or t
  modified_base (355)..(355): a, c, t, g, unknown or other
  misc_feature (355)..(355): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttangcttatgctactgggtcccgccaggcctccgaggggaagggctaggaatatgtctcgaggtattagaagtaangacgaaataacatataattatagactaaaactctaggtggaagggtcaggtattacaccgaatcctaccgagggaactaacttaccaaagaacacgtcttagtactaccttaacaaagtgggacaacgcctagaacgagacgtggaacggtacacgggacttaggtatacgttacgtagggtacggggagtaagggtacggtacggtaaggttacggaacggttaaggggttgggtacggggaccggtaagggg

SEQ ID NO: 267954 - DNA, 566 bp, Homo sapiens
  misc_feature: GYAE6OF02H3QO0.28.57.F02.1.454.CMB.1.raw
  modified_base (344)..(344): a, c, t, g, unknown or other
  misc_feature (344)..(344): n is a, c, g, or t
  modified_base (471)..(471): a, c, t, g, unknown or other
  misc_feature (471)..(471): n is a, c, g, or t
  modified_base (479)..(479): a, c, t, g, unknown or other
  misc_feature (479)..(479): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctatttttaaaggtgtccagtgtgaggtgcagctggtggagtcgtgggggaggcttgggtccagccgtggggggtccctgagactctcctgtgcagcctcgtggattcaccttcagttattttatgctatgctacgtcgggtccgccgaggcctccgaggggaagggactggaatatgtctnaggtattagaatatgacaataacatatattatgacaaactctgtaggaagggacagtattccaacctatcctacgagggaactaacttaccaagaaccacgtcttagtactcttacaaagtgggacngcctgagngctgaacggcacgctagtatagttcgtaggtggaggaggagtacgggtaagttcggaaggttaggggttcggtcggggactaagggg

SEQ ID NO: 267955 - DNA, 598 bp, Homo sapiens
  misc_feature: GYAE6OF02IPK15.28.57.F02.1.454.CMB.1.raw
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagttatttatgctatgcactgggtccnccaggctccgaggggaagggactgggaatatgtctnaggtattaagaagtatgacgaaataacataattattatgactaaactctagtagaacgggcagtattccaacatctaccgagggacaacttaccaaagaacacgtactagttactccttacaaagtcgggactaggtccctaggagacgtcgtaggacggacaacgggctagtataagttacgtggtagggaggtaagggacggacgggtaagttacggggtaaacgttagggggtttcggtcgggggacctaacggggg

SEQ ID NO: 267956 - DNA, 542 bp, Homo sapiens
  misc_feature: GYAE6OF02HBI1Q.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaataacatatattatgacaactctgtagaagggcagattcaccatctcgaggactaattaccaaagaacacgctagtactcttacaaagtgggacagcctgagagctagaggacacggctgtatagttacgtggtagggagaggagaggtaagttgggaacgttaggggttggtacggggtccaaggggg

SEQ ID NO: 267957 - DNA, 565 bp, Homo sapiens
  misc_feature: GYAE6OF02IJ0H3.28.57.F02.1.454.CMB.1.raw
  modified_base (551)..(551): a, c, t, g, unknown or other
  misc_feature (551)..(551): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagtatttatgctatgcactggggtccgccaggcctccgaggggaagggactggaatatgtctcgtaggtattagaagtatgacgaataacatatattatgacaactctgtagaagggcagtattcacctatcctaccgagggtaaccaattaccaaagaaccacgtactagtattacttacaaagtcgggacacgcctagagacgctagaacggacacggcttagtattatacgtggtagggagagggagacgggtaatggaacgttagggttcggnggggaccgtagggg

SEQ ID NO: 267958 - DNA, 549 bp, Homo sapiens
  misc_feature: GYAE6OF02G5747.28.57.F02.1.454.CMB.1.raw
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttgggttcagcctggggggtccctgagactctcctgtgcagcctctggattcaccttcagtatttangctatgcatgggtccnccagggctccgagggaagggactggaatntgtctgagtattaagaagtaatgacgaataacatatattangacaaactntgtagaagggcagattcacatctacgaggacaattccaagaacacgctagtatcttacaaagtggacagcctagacgagtcgtagaggacaacggcttagtattacttagtggtacgggagtaggacgaggtaagttcggaacggttagggttaggtacggggacgtaacgggg

SEQ ID NO: 267959 - DNA, 572 bp, Homo sapiens
  misc_feature: GYAE6OF02ILSUM.28.57.F02.1.454.CMB.1.raw
  modified_base (362)..(362): a, c, t, g, unknown or other
  misc_feature (362)..(362): n is a, c, g, or t
  modified_base (441)..(441): a, c, t, g, unknown or other
  misc_feature (441)..(441): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggagggctggatatgtctcaggtatagaagtaatgcgaataacataatattanagactaaaactctagtgaagggcaagtacttcaaccatctacctagggactaattccaaagaacacgctagtatcttanaaatgggcagcctgagagtctagacggacacgggtctagttagtatttacggtggtacgggagtaagggacgtacgggtaagttgggtaaaccgttagggggtttcggttacgggggacccgtaacggggg

SEQ ID NO: 267960 - DNA, 535 bp, Homo sapiens
  misc_feature: GYAE6OF02GEVMD.28.57.F02.1.454.CMB.1.raw
  modified_base (447)..(447): a, c, t, g, unknown or other
  misc_feature (447)..(447): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactggtccgccaggctccagggaagggactggaatatgtctcaggtattagaagtaatgcgaataacatatattatgacaaactctgtagaagggcagattcaccatctccaggacaattccaagacacgctgtatcttacaaatgggcagcctgagngctgagacacggctgtattattacgtggtagggagaggagacgggtaattgggaaacgttaggggtttggtaggggccgtaacggggg

SEQ ID NO: 267961 - DNA, 677 bp, Homo sapiens
  misc_feature: GYAE6OF02I4YBL.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaaggactggaatatgtctcaggtattagaagtatgcgaataacatatattatgacaaacttctagtaggaagggcaaggtatttaccgacccaattcctacccgaaggggaaccaaacgtttcccaaaaggaaccaaccggtacttaggttaactttccgttaacaaaacgttcggggacctaaggtcccttagggaacgacggtaccgttacggggaaagggtaccccgaacgggtaccgttaggttaacttaacgtttaaccgtggggttacgggaagggtaacgggtaaggtacggggtaaagtttcgggggtaaaaccgtttaggggggtttaggttacgggggggacccgtaaacgggggg

SEQ ID NO: 267962 - DNA, 550 bp, Homo sapiens
  misc_feature: GYAE6OF02F8S12.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtggggggtccctgagactctcctgtgcagcctctggattcacctttcagttatttatgctatgcactgggtcccgccaggctccgaggggaaggactggaatatgtctcagggtattagaagtaatgacgaataacatatattatgacaaactctgtgaagggcagatcacatctcaggacaattccaaagaacacgactagttactcttacaaagtcgggacagcctagagagcgtagacggacacggctagtatagttactggtagggaggagggagaggagttagggaacgttaggggttgggtacgggacgtaacgggg

SEQ ID NO: 267963 - DNA, 539 bp, Homo sapiens
  misc_feature: GYAE6OF02H2VU0.28.57.F02.1.454.CMB.1.raw
  modified_base (435)..(435): a, c, t, g, unknown or other
  misc_feature (435)..(435): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgccaggcctccgagggaaggactggaatagtgtctcaggtattagaagtaatgcgtaataacatataattatgacaaactctgtagaagggcagattcaccatctccaggacaagttaccaagaacacgctagtatctanaaatcggacagctgagagctgaggacacgctgtattagttacgtggtagggagagggagacgggaagttagggaacgttaggggttggtcggggcgtaacgggg

SEQ ID NO: 267964 - DNA, 539 bp, Homo sapiens
  misc_feature: GYAE6OF02GMGOP.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccnccaggctccagggaaggactggaatatgtctcaggtattagaagtaatgacgaataacattatattatgacaaactctgtagaagggcagattacaccatcctcgaggaacaattcaagacacgctagtactctacaaatgggacagacctgagagcgtagagacacgctgtatagttacgtggtaggaggaggagtacgggtagttagggaagttggggtaggtgggggaccctaagggg

SEQ ID NO: 267965 - DNA, 551 bp, Homo sapiens
  misc_feature: GYAE6OF02HCRTG.28.57.F02.1.454.CMB.1.raw
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcacctttcagtatttatgctatgcactgggtcccgccaggcctccgaggggaagggactggaatatgtctcaggtattagaagtaatgcgaaataacatatattangacaaactctagtgaagggcagattcaccatctccaggacaattccaaagaacacgctagtatcttacaaagtgggacacgcctagagagctagacggacacggctagtattattacgtggtcgggagagggagacggtaagttagggaacgttaggggttcggtagggggacctacgggg

SEQ ID NO: 267966 - DNA, 544 bp, Homo sapiens
  misc_feature: GYAE6OF02F5KRQ.28.57.F02.1.454.CMB.1.raw
  modified_base (454)..(454): a, c, t, g, unknown or other
  misc_feature (454)..(454): n is a, c, g, or t
tcagagtacgctatcacgaccggtgctcgatttagctcgatatagttgggtctgggtaggtagggagcccccgccctgggtttcccaggtcgttctcatttggtgatcgagcactgccacgacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggctggaatatgtctcaggtattagaagtaatgcgaataacatatattatgacaaactctgtgaagggcagattcacatctccagggacaattccaaagaacacgctgtatcttacaaatgggcagcctgagngctgagacacgctgtatatacgtggtagggagtagggagacgggaagtttgggaaacgttagggggttaggtgggggaccgtaacggggg

SEQ ID NO: 267967 - DNA, 548 bp, Homo sapiens
  misc_feature: GYAE6OF02G5JBT.28.57.F02.1.454.CMB.1.raw
  modified_base (368)..(368): a, c, t, g, unknown or other
  misc_feature (368)..(368): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttcctgttgctattttaaaggtgtccagtgtgaggtgcagctggtggagtctgggggaggcttggtccagcctggggggtccctggagactctcctgtgcagcctctggattcaccttcagttatttatgctatgcactgggtccgccaggctccgagggaagggactggaatagtgtctcaggtattagaagtatgacgaataacatatattacngacaaactctgtagaagggcagattcactatctccaggacattccaaagacacgctagtactacttacaaatgggacagtcctagagagctagagaccacgggtctaggtatattacgtggtaggaggtaggagtacggaagtttcgggaacgttggggttaggtacggggcctaagggg

SEQ ID NO: 267968 - DNA, 531 bp, Homo sapiens
  misc_feature: GYAE6OF02GF18X.28.57.F02.1.454.CMB.1.raw
  modified_base (297)..(297): a, c, t, g, unknown or other
  misc_feature (297)..(297): n is a, c, g, or t
  modified_base (411)..(411): a, c, t, g, unknown or other
  misc_feature (411)..(411): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaagggctgggaatatgtctcgaggtatagaagtaatgacgaataacataatattatgacaaactctgtagaaggcagattcacatctcaggacaatcaanacacgctagtatcttacaaatgggacagcctgagagctggagacgacgctgtatagttacgtggtagggaggaggagacggaagttaggaacgtagggttcggtaggggacgtaacgggg

SEQ ID NO: 267969 - DNA, 527 bp, Homo sapiens
  misc_feature: GYAE6OF02G7UDF.28.57.F02.1.454.CMB.1.raw
  modified_base (299)..(299): a, c, t, g, unknown or other
  misc_feature (299)..(299): n is a, c, g, or t
  modified_base (446)..(446): a, c, t, g, unknown or other
  misc_feature (446)..(446): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggcctggggggtccctgagactctcctgtgcagcctctggattcaccttcagtatttatgctatgcactgggtccnccaggctccgagggaagggactggaatatgtctcaggtattagaagtatgacgaataacatatattatgacaaactctgtgaagggcagatcacatctcaggacaattcaagacacgctagtatcttacaaatgggacagcctgagngctgaggacacggctgtatagttacgtggtaggagaggagcggaagttgggaacgttaggggttggcggggacgtacgggg

SEQ ID NO: 267970 - DNA, 538 bp, Homo sapiens
  misc_feature: GYAE6OF02GLR5I.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaaggactggaatatgtctcaggtattaagaagtaatgacgaataacataatatatgactaaactctgtagaagggcagattcacatctacaggactaatccaacgaacacgctgtactcttacaaagtgggacagacctgagagcgtgagacagctgtatagttacgtggtagggaggaggagacgggtaattgggaacgttaggggttggtaggggaccgtagggg

SEQ ID NO: 267971 - DNA, 623 bp, Homo sapiens
  misc_feature: GYAE6OF02HTT4X.28.57.F02.1.454.CMB.1.raw
  modified_base (297)..(297): a, c, t, g, unknown or other
  misc_feature (297)..(297): n is a, c, g, or t
  modified_base (619)..(619): a, c, t, g, unknown or other
  misc_feature (619)..(619): n is a, c, g, or t
tcagagtacgctatcacgaccggtgctcgatttagctcgatatagttgggtttgggggtccctgagactctcctgtgcacgcctctggatttcaccttcagtatttatgctatgcactgggtccgccaggctccagggaagggactggaatatgtctcaggtattagagtaatgcgaataacatatattatgcaaaactctgtgaagggcagattcaccatctccaggacaattccaagaacacgctgtatcttcaaatggcagcctgagagctgaggacacggctgtatattacgngtcggagaggagcgaatggaacgtaggttggtggggccagggagcccgtggtcaccgtctcctcagcctaccaccgaacggcccaagtccggtaccttcccccgtagggtcccgccccgtcgccgtccgacgggtacgccgtaccctccggaacgacgtaccaacgacgccggccccgtggggcccttcggtacccgtacggggtaccaaacggggtaccttaaccgtttaccgaaacgttacggtccgttaccttccggttacggaacggcccggggtacgtcgggtaccgtaacgggtccggacctacgttacggctcgntacg

SEQ ID NO: 267972 - DNA, 540 bp, Homo sapiens
  misc_feature: GYAE6OF02HY0YV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaataacatatattatgacaaactctgtgaagggcagattcacatctcaggacaattcaagaacacgctgtatcttacaaagtgggacagcctgacgagcgtagaggacacggctgtatattacgtggtagggagaggagacggtaagttacgggaacgttaggggttggtcggggaccgtaacggggg

SEQ ID NO: 267973 - DNA, 544 bp, Homo sapiens
  misc_feature: GYAE6OF02JWY35.28.57.F02.1.454.CMB.1.raw
  modified_base (156)..(156): a, c, t, g, unknown or other
  misc_feature (156)..(156): n is a, c, g, or t
  modified_base (163)..(163): a, c, t, g, unknown or other
  misc_feature (163)..(163): n is a, c, g, or t
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (384)..(384): a, c, t, g, unknown or other
  misc_feature (384)..(384): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagcgtggttttcgtntaggctntttaaaggtgtccagtgtgaggtncagctggtggntctgggggagccttggtccagcccgttgggggtcccctgagccntcctgtgcagcccttntgggattcaacctttcaggtatttatcggcatgctcngtcgcngntcngaggatganatgtntcaggtnttanagtaatgcgatacatatattaatgcaaactctnttgaagggcacattcacccnctctcacgacactaccaacacacnctntatcttactactaggcgacgcgtacgagagacgtagacgacgacgacgtagtattacgttacgtaggtagggagggaaggacggacggtaacggtacggtacggttacgggttacgggtcgggtacggacggg

SEQ ID NO: 267974 - DNA, 538 bp, Homo sapiens
  misc_feature: GYAE6OF02F926H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaaggactggaatatgtctcaggtattagaagtaatgacgaataacataatattatgacaaactctgtgaagggcagattcacatctcaggacaattcaagaacacgctgtatcttacaatgggcagcctgagagcgtagaggacacggctagtatacttacgtggtgggaaggaggaggcgggtaagttgggtaacgttaggggttcggtaggggaccgtaagggg

SEQ ID NO: 267975 - DNA, 535 bp, Homo sapiens
  misc_feature: GYAE6OF02JHNXC.28.57.F02.1.454.CMB.1.raw
  modified_base (375)..(375): a, c, t, g, unknown or other
  misc_feature (375)..(375): n is a, c, g, or t
  modified_base (462)..(462): a, c, t, g, unknown or other
  misc_feature (462)..(462): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactntgtgaagggcagattcaccatctcagggacaattccaagacacgctgtatcttacaagtggacagcctgagagctagaggacacggntagtattagttacgtggtagggagagggagagggtaattgggaacgttggggttaggtcggggcgtaacgggg

SEQ ID NO: 267976 - DNA, 614 bp, Homo sapiens
  misc_feature: GYAE6OF02IJ0ND.28.57.F02.1.454.CMB.1.raw
  modified_base (285)..(285): a, c, t, g, unknown or other
  misc_feature (285)..(285): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtgggggggtccctggagactctcctgtgcagcctctggattcaccttcagtatttangctatgctacgtcgggtcccgccgaggcctccggaaggggaacgggctaggaatatgtctacgaggtattaagaagtaatgacgtaaataacattattaattatagactaaactctagtaggaagggcaagtacttcacctatacctaccgaaggaacctaattaccaagaaccagctagtattccttanaaagtggacacgtctagagacgcgtagacggacgaccgggtacttaggtacttacgtttacggtggttaggggagaagggtaggacgggttaagttacgggtaacgttagggggttacggtcgggggaccgtaacgggg

SEQ ID NO: 267977 - DNA, 545 bp, Homo sapiens
  misc_feature: GYAE6OF02IUPBT.28.57.F02.1.454.CMB.1.raw
  modified_base (299)..(299): a, c, t, g, unknown or other
  misc_feature (299)..(299): n is a, c, g, or t
  modified_base (332)..(332): a, c, t, g, unknown or other
  misc_feature (332)..(332): n is a, c, g, or t
  modified_base (377)..(377): a, c, t, g, unknown or other
  misc_feature (377)..(377): n is a, c, g, or t
  modified_base (432)..(432): a, c, t, g, unknown or other
  misc_feature (432)..(432): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgctactgggtccncaggctccgagggaacggactggaatatgtctnaggtattagaagtaatgacgtaataacatatataatgacaaactntgtagaggcagattcacatctcaggacaataccaagacagctagtatctaacaangggacagacctgagagcgtgaagcacggcttaggtattacgttacgtggtacggaaggtacgggagacgggtaagttcgggaacgtttagggtggtacggggaccgtaagggg

SEQ ID NO: 267978 - DNA, 550 bp, Homo sapiens
  misc_feature: GYAE6OF02GRVFQ.28.57.F02.1.454.CMB.1.raw
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtggggggaggcttggtccagccgtggggggtccctgagactctcctgtgcagcctctggattcaccttcagtatttatgctatgcactgggtccgccaggcctccgaggggaaggactggaatatgtctcaggtattagaagtatgacgaataacatatattatgacaaactctgtgaagggcagtattcaccatctccgaggacaatcaanacacgctagtatcttanaaagtgggacagcctagagagcgtagaaggacaacgggtctagtattattacgtggtacgggagaggagacggtaagttagggaacgttaggggttggtcggggaccgtaacgggg

SEQ ID NO: 267979 - DNA, 558 bp, Homo sapiens
  misc_feature: GYAE6OF02H91IV.28.57.F02.1.454.CMB.1.raw
  modified_base (370)..(370): a, c, t, g, unknown or other
  misc_feature (370)..(370): n is a, c, g, or t
  modified_base (403)..(403): a, c, t, g, unknown or other
  misc_feature (403)..(403): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttttaaaggtgtccagtgtgaggtgcagctggtggagtctggggggaggcttggtccagccgtgggggggtccctgagactctcctgtgcagcctctggattcaccttcagtatttatgctatgcactgggtccgccaggctccgaggggaagggactggaatatgtctcaggtattagaagtatgacgaataacatatattangacaaactctgtagaagggcagattcaccatcnccgagggacaattaccaagaacacgctagtatcttacaaagtgggacacgcctgagagctagaggacacggctgtattattacgtggtagggaggaagggagacgggtaattcgggaaacgttaggggttcggttacgggggaccgtaacggggg

SEQ ID NO: 267980 - DNA, 776 bp, Homo sapiens
  misc_feature: GYAE6OF02FFD42.28.57.F02.1.454.CMB.1.raw
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagtctgggttttccttgttgtcttattttaaaggtgtccagtgtgaggtgcagcgtggtggagtcgtgggggagtcttggtccagccggtgggggtccctgacgtctctctgtgcacgcctctggtacttcaccttnagttattatgctatcgctacggtcggtcccgcgacggcctaccggaaggggtaacggacgtaggtaaatgtcgtactacgtaaggttaataaggaagtaatggaactaaataactaattaataattacgtacgaaactaacgtcggtaggtacggaacggtactaacgttacttaccaacctacgtcccgtaaacggacggtaaaccttaaccgtaaccgaaacgaccgtacgttactaacgttacttaccgtaacgtaacggtccggaacgtcggtaccgtacgaaggtaccgtacggtaacgggacccgtaaacggttccggttacgttaagggtttacgtaaccggtttaccggggttaaggggaacggggtaaacgggttaacgggggttaaccggggtaaacgggttttaaacgggggttaacccgggggttaaacggggttttagggggtacccgggggttaccggggtacccggggttaaccccggggg

SEQ ID NO: 267981 - DNA, 596 bp, Homo sapiens
  misc_feature: GYAE6OF02IP9K9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggaggcttggtccagcctggggggtccctgagactctcctgtgcagcctctggattcaccttcagtatttatgctatgcactgggtccgccaggctccgaggggagggactggaatagtgtctcgaggtattagaagtatgacgaataacatatattatgactaaactctagtagaagggtcaagtattccaaccatccgtacccgaagggtacctaaagttcccaaagaaccacgcttagtacttcgttacaaagtcgggacacgtcctagagtagcgtaggaaggaccgacggtcttagtatagtttacgtgggttacgggaaggtagggacggtacgggtaagttcgggaacgttagggggttcggtacggggcctaacggggg

SEQ ID NO: 267982 - DNA, 543 bp, Homo sapiens
  misc_feature: GYAE6OF02F7DFK.28.57.F02.1.454.CMB.1.raw
  modified_base (301)..(301): a, c, t, g, unknown or other
  misc_feature (301)..(301): n is a, c, g, or t
  modified_base (505)..(505): a, c, t, g, unknown or other
  misc_feature (505)..(505): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtcccnccaggctccgaggggaagggactggaatatgtctcaggtattagaagtaatgacgaataacatatattatgacaaactctgtaggaagggcagtattcaccatctccagggactaattccaagaacacgctagtactcttacaaatgggacagcctagagacgcgtgaggacacggctagtatattacgtggtggaagaggagnggaagttggaacgttggggttggtaggggccaacgggg

SEQ ID NO: 267983 - DNA, 528 bp, Homo sapiens
  misc_feature: GYAE6OF02GBVGB.28.57.F02.1.454.CMB.1.raw
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgacgaataacatatattatgcaaactctgtgaagggcagattcacatctccagggacaattccaagaacacgctagtatcttacaaatgggacagcctgagagctgagacacggntgtatattacgtggtagggagaggagcgggaattcgggaagttagggtcggtagggccgtaacgggg

SEQ ID NO: 267984 - DNA, 569 bp, Homo sapiens
  misc_feature: GYAE6OF02HT2BM.28.57.F02.1.454.CMB.1.raw
  modified_base (174)..(174): a, c, t, g, unknown or other
  misc_feature (174)..(174): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttttaaggngtccagtgtgaggtgcagctggtggagtcgtgggggaggcttggtccagccgtggggggtccccgtgagactctccctgtgcagcctctggattccaccttcagtatttatgctatgcactgggtccgccagggctccgaggggaagggactggaatatgtctcaggtattagaagtaatgcaataacatattatatgacaaactctgtagaagggcagattcaccatcctaccgagggactaattccaaagaacacgctagtattcttacaaagtgggcaacgcctagagacgctgacgggaccaacggtcttagttatagtttacggtggtaggggagaggagacgggtaagttagggtaacgttaggggttaggtcgggggacctaacgggg

SEQ ID NO: 267985 - DNA, 537 bp, Homo sapiens
  misc_feature: GYAE6OF02GI3IY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactctgtgaagggcagattcacatctcaggacaattccaagaacacgctgtatcttacaaatgggacagcctgagagctagaggacacggctagtatattacgtggtagggagaggaggacggtaagttcgggaaacgttaggggttggtaggggcgtaacggggg

SEQ ID NO: 267986 - DNA, 564 bp, Homo sapiens
  misc_feature: GYAE6OF02HD4CE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggggtccctggagactctcctgtgcagcctctggattcaccttcagtatttatgctatgcactgggtccgccaggctccgaggggaaggactggaatatgtctcgtaggtattaagaagtaatgacgaaataacatatatatagacaaactctgtagaagggcagatcaccatctacgaggactaattccaaagaacacgcttagtactcttacaaagtcgggacagcctagacgagcctaggaacggacacggctagtatagttacgtggtacgggagaagggacgtacggaagttagggaacgttaggggttcggtacgggacgtacgggg

SEQ ID NO: 267987 - DNA, 540 bp, Homo sapiens
  misc_feature: GYAE6OF02FZ180.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcaggtattagaagtaatgcgaataacatatattatgacaaactctgtagaagggcagattcacatctccaggacaattccaagaacacgctagtatctacaaagtgggacacgcctagagagcgtaggacgacgacggctagtatattacgtggtagggagaggagacggtaagttcgggaacgttaggggttggtaggggccgtaagggg

SEQ ID NO: 267988 - DNA, 525 bp, Homo sapiens
  misc_feature: GYAE6OF02G3W86.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggagggactggaatatgtctcaggtattagaagtaatgacgaataacatatattatgacaaactctgtgaagggcagattcaccatctccagggacaattccaagaacacgctgtatcttacaatgggcagcctagagagctgacggacacggctgtatattacgtggtggagaggagcggtaagttgggaacttaggggttgtggggacgtagggg

SEQ ID NO: 267989 - DNA, 528 bp, Homo sapiens
  misc_feature: GYAE6OF02IQZ3P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgacgaataacataatattatgacaaactctagtgaagggcagattcaccatctccagggacaattccaagaacacgctagtatcttacaaatgggacagcctgagagctgaggacacggctgtatattacgtggtgggagaggagcggaagttaggacgtagggttggtggggctaacgggg

SEQ ID NO: 267990 - DNA, 556 bp, Homo sapiens
  misc_feature: GYAE6OF02IQFJ6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtccgccgaggcctccgagggaagggactggaatatgtctcaggtatagaataatgacgaataacatatattatgacaaactctagtgaagggcagtattcacatctacgaggacaattaccaagacacgctgtactcttacaagtggacagcctagagtacgacgtgaaggaaccacgggcttagtattagttacgtggtagggaggtaggagcgggttaagttagggtaacgttggggttaggtcgggggacctagggg

SEQ ID NO: 267991 - DNA, 535 bp, Homo sapiens
  misc_feature: GYAE6OF02GR19Z.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgccaggctccagggagggactggaatatgtctcgaggtattagaagtaatgcgaataacatatattatgcaaactctgtgaagggcagattcaccatctccagggacaattccaagacacgctgtatcttacaatgggcagcctagagagctagacggacgacggctagtatattacgtggtagggagaggagacggtaagttcgggaacgttaggggtttaggtggggaccgtacgggg

SEQ ID NO: 267992 - DNA, 561 bp, Homo sapiens
  misc_feature: GYAE6OF02HGPBC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactgggaatatgtctcaggtattagaagtatgacgaataacatatattatgacaaactctgtgaagggcagtattcaccatctcagggacaattccaagaaccacgctgtatcttacaagtcgggacacgcctagagagtcgtggacggacacgggctagtattagttacgtggtaggggagaggacggacggtaagtttcgggaaacggttaggggtttacggtacgggggtccgtaacggggg

SEQ ID NO: 267993 - DNA, 609 bp, Homo sapiens
  misc_feature: GYAE6OF02H6LA0.28.57.F02.1.454.CMB.1.raw
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (414)..(414): a, c, t, g, unknown or other
  misc_feature (414)..(414): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtgggagtcgtggggggaggcttggtccagccgtggggggtccctgagactctcctgtgcagcctctggattccacctttcagtatttatgctatgcacgtgggtcccgcccaggcctaccgaggggaacggactaggaatatgtctcgaggtatagaagtaatgacgtaaataacatatattanagacaaactntgtgaagggcagtatcacatcncgaggacaactacaagaacacgctagtatcttacaagtcgggacagtcctagagagtccgtaggaacggacgaaccgggtctagttactttagttaacggtggtaaggggacgggtaagggtaacggaggggttaacggttacgggtaaacggtttacggggggtttagggttaccgggggaccggtaacggggg

SEQ ID NO: 267994 - DNA, 588 bp, Homo sapiens
  misc_feature: GYAE6OF02JBBRJ.28.57.F02.1.454.CMB.1.raw
  modified_base (295)..(295): a, c, t, g, unknown or other
  misc_feature (295)..(295): n is a, c, g, or t
  modified_base (362)..(362): a, c, t, g, unknown or other
  misc_feature (362)..(362): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtaggctattttaaagtgtcagtgtgaggtgcagctggtggagtctgggggaggcttggtccagccgtggggggtccctgagactctcctgtgcagcctctggattcaccttcagttatttatgctatgcactgggtccncaggctccgagggaaggctggaatatgtctcgaggtattagaagtatgacgtaataacatatattangacaatctagtgaaggcagattcacatctcgaggacaagttcaaagacacgtctagttatctttacaaagtgggacaggtcctaggagagtacgtagacgggtacacgggtctggttacttacgtttacgttaggggtacgggaagggtaggtaacggtacgggttaaagtttacggggtaaccggtttaaggggggttcggtacggggggacccgtaacgggggg

SEQ ID NO: 267995 - DNA, 569 bp, Homo sapiens
  misc_feature: GYAE6OF02HRA9A.28.57.F02.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttgggtccagccgtggggggtccctggagactctcctgtgcagcctctggattcaccttcagtatttangctatgcactgggtccncgagctcgagggaggctggaatatgtctnaggtattaagaagtatgacgaaataacatatattangactaaactgngtagaaggtacagtattaccactatcgtaccagggaactaacttaccgaaagaccacggctagttaatcctaagtaagtgggacacggaccttggaagcgacgagacggtacgacgtctagttacttagtacgtggtaggagtacggagtacggtagtacgggtaacgttgggtaggtggggaccaagggg

SEQ ID NO: 267996 - DNA, 833 bp, Homo sapiens
  misc_feature: GYAE6OF02JH5MC.28.57.F02.1.454.CMB.1.raw
  modified_base (345)..(345): a, c, t, g, unknown or other
  misc_feature (345)..(345): n is a, c, g, or t
tcagagtacgctatcacgaccggtgctcgatttagctcgatatagttgggtctgggagaggagcccccgccctgggtttcccaggtgttctcatttggtgatcagcactgcacacaagaagagtcatgacggtaggttggctgagcgttcggttttccgttgttgtctttaaagtttttaaaggttcgtccgtagttgtggtaggtgcgagtcgtgggtaggtagttcgggtgggggaggtcgttcggtaccgacgtccgggtccgggggttccctggacgtacctccgttccgtggtcgcgacgccttcgtggtacttacctacccttctaagtttacttttancgtacttagtcgacgtacggttcggggtccccgaccgtacggtccgtacccgggaaggggaacgggtaccgtaaggtaattacgtcgttcctacggtaaggtttaagttaaggtaagttaagtacgaaccgtaaataactattaagttattagtcgaaaccttaacttacgttaggtaacgggaagtaccgtaagttaacgttaccctaaaccgtactttacccgtaccggaaacggtaaactttaaccttaaccgaaaccgtaaaccgaccgttacttacgttaactttaccttaaacgtaaaggtcgggaacctaccgtaccgtaaggtaacggacgtacggtaacggaacggaaccgaccggttgttaacgttagtttaacgttaacggtggggttaacggaagggtaacggtaaccggtaggttaaacggtttacggggaaacggtttgggggtttacggggtaccgggtaccgggtaaacggg

SEQ ID NO: 267997 - DNA, 564 bp, Homo sapiens
  misc_feature: GYAE6OF02GIHDK.28.57.F02.1.454.CMB.1.raw
  modified_base (374)..(374): a, c, t, g, unknown or other
  misc_feature (374)..(374): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctcgggtttcccacggtgttctcatttggtgatcagcactgcacacagaagagtcatgacggagtttgggctgagctgggttttccttggttgctatttttaaaggtgtaccagtgtgaggtgcagctggtggagtcgtgggggaggcttgggtccagccgtggggggtccctggacgactctcctgtgcagcctctggattcgacctttcagtactttatgctatgcactgggtccgccaggcctccaggggaaggctagggaatagtggtctcgaggttattagaataatgacgaataacntatacttatgacaaactctagtagaagggcagtattcacatctaccgagggactaattaccaacgaacacgtactagtactctacgaaagtcggacacgcctgagngacgtagaggacacggctagtatagtacgtggtggaggaggagacggtagttggaacgttagggttggtggggacgtaacgggg

SEQ ID NO: 267998 - DNA, 585 bp, Homo sapiens
  misc_feature: GYAE6OF02IB3KN.28.57.F02.1.454.CMB.1.raw
  modified_base (176)..(176): a, c, t, g, unknown or other
  misc_feature (176)..(176): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (379)..(379): a, c, t, g, unknown or other
  misc_feature (379)..(379): n is a, c, g, or t
  modified_base (444)..(444): a, c, t, g, unknown or other
  misc_feature (444)..(444): n is a, c, g, or t
tcagagtacgctatcacgaccggtgctcgatttagctcgatatagttgggtctgggagaggagcccccgccctgggtttcccaggtgttctcatttggtgatcagcacctgcacaccagaagagtcatgacggagtttgggctgagctgggtttccttgttgctatttttaaaggngtccagtgtgaggtgcagctggtggagtcgtgggggagcgttggtccaggccgtggggggtccctggagactctcctgtgcagcctgtgattcacttcagtatttangctatgcacgtcgggtccncctaggctaccgaagggaacggctggaatagtgtctcgaggtattagaagtaagtgacgtaataacatactaattangacaaacttctagtagaagggctagattcgacctatctacccgaggtactaacttacgaagaacngactagtacttaccttagaaagtgggacagtaccgtagacgagacctaggacggaacacggtcgtagacgttagttacgcggtaggagacggaacggtggtaaggttacggacgttaggggtgtacgggacgtaaccgggg

SEQ ID NO: 267999 - DNA, 577 bp, Homo sapiens
  misc_feature: GYAE6OF02GMHHL.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggcctccgaggggaagggactggaatagtgtctcgaggtattagaagtaatgacgaataacatatattatgactaaactctgtagaagggcagattcacatctcgaggactaacttccaaagacacgctgtactcttacaagtgggacagcctgacgagtctaggacggaccgacggcttagttattacgtttaacgtgggtagggaacggagggtacggacgggtaaagttcggggaaacgttagggggtttcggtacgggggaccgtaacggggg

SEQ ID NO: 268000 - DNA, 573 bp, Homo sapiens
  misc_feature: GYAE6OF02I4820.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttgggtccagcctggggggtccctgagactctcctgtgcagcctctggattcaccttcagtatttatgctatgcactgggtccgccaggctccgagggagggactggaatatgtctcaggtattagaagtaatgacgaataacatatattatgactaaactctagtagaagggcagtattacacatctacagggacaattaccaaagaacacgtactcgtaactcttacaaagtgggacagaccgtgaacgagcgtagaacggacgacggctagtattagttacgtggtacgggaggtaggaggtacgggaagttagggtaaccggttaggggttacgggtacgggggccgtaacgggg

SEQ ID NO: 268001 - DNA, 516 bp, Homo sapiens
  misc_feature: GYAE6OF02GQ2LB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgcaggctccagggaaggctggaatatgtctcaggtattagaagtaatgacgaataacatatattatgacaaactctgtagaagggcagattcacatctaccaggacaattaccaagaacacgctgtatctcaaatggcagcctgagagctgagacgacgctagtactattacgtgtagggagaggagcggtaagttggaagtagggtgtcggggcagggg

SEQ ID NO: 268002 - DNA, 513 bp, Homo sapiens
  misc_feature: GYAE6OF02FYNRK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggactggaatatgtctcaggtattagaagtaatgcgaataacatatattatgacaaactctgtgaagggcagattcacatctccaggacaattccaagaacacgctagtatcttcaaatgggacagcctgagagctgagacacggctgtatattacgtgtgggagaggagcggattggaacgttagggtgtgggcagggg

SEQ ID NO: 268003 - DNA, 535 bp, Homo sapiens
  misc_feature: GYAE6OF02F2530.28.57.F02.1.454.CMB.1.raw
  modified_base (451)..(451): a, c, t, g, unknown or other
  misc_feature (451)..(451): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccgcagggctccgaggggaagggactggaatatgtctcaggtattagaagtaatgacgaataacatatattatgacaaactctgtagaagggcagattcacatctcaggacaattaccaagaacacgctgtatcttacaaatgggacagcctgagngctgacgacacggctagtatatacgttggtaggaggagaggacggtaagttggaacgttaggggttggtcggggccgtaagggg

SEQ ID NO: 268004 - DNA, 628 bp, Homo sapiens
  misc_feature: GYAE6OF02I5TMP.28.57.F02.1.454.CMB.1.raw
  modified_base (283)..(283): a, c, t, g, unknown or other
  misc_feature (283)..(283): n is a, c, g, or t
  modified_base (332)..(332): a, c, t, g, unknown or other
  misc_feature (332)..(332): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttangctatgcacgtgggtcccgccagggctccgaggggaagggactggaatntgtctcaggttatagaagtaatgacgaaataacattaatattatagacaaactctaggtaggaagggcagtacttcaccatcctcaagggacaattaccaaagacacgctagtactcttacaaagtcgggacacggtcctaggacgtaggtacgttagggaacgggacccgtaacgggtccttaggttaactttaacgttacggttagggttggggaaggtaagggtaggtaccggggtaagtttacggggtaaccggtttagggggttacgggttacgggggaccggtaacgggg

SEQ ID NO: 268005 - DNA, 555 bp, Homo sapiens
  misc_feature: GYAE6OF02FNIWH.28.57.F02.1.454.CMB.1.raw
  modified_base (459)..(459): a, c, t, g, unknown or other
  misc_feature (459)..(459): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaaggactggaatatgtctcgaggtattagaagtaatgacgaataacatatattatgacaaactctagtgaagggcagattcacatctaccgagggactaattaccaaagaacacgctagtactcttacaaagtgggacagcctgagngctgaggacacggctagtatagttacgtggtagggaggaggaggacggtaagttcgggtaaacggttaggggttaggtcgggggaccgtacggggg

SEQ ID NO: 268006 - DNA, 605 bp, Homo sapiens
  misc_feature: GYAE6OF02FHSCI.28.57.F02.1.454.CMB.1.raw
  modified_base (274)..(274): a, c, t, g, unknown or other
  misc_feature (274)..(274): n is a, c, g, or t
  modified_base (481)..(481): a, c, t, g, unknown or other
  misc_feature (481)..(481): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttggggctgagctgggttttccttgttgctatttttaaaggtgtccagtgtgaggtgcagctggtggagtctgggggagcttggtccagcctggggggtccctgagactctcctgtgcacgcctcgtggtattccaccttnacgtttatttatgtctatgacacgttcgggtcccgcgaggctccgaagggaaggctaggaatatggtctacgaggttattaaggaagttaagtggaacgtaataacaattataattatcgactaaactctggtaggtaagggcagtacttacgactatcctaccgagggaactaacgttaccaagaacacgactagttactacttanaagtacgggacagccgtagaagacgtactagggaacgtaccgacggtcttagtatacttacggtggtagggagaggaggtaacggagttacgggaagttgggtcggtacgggaccggtacgggg

SEQ ID NO: 268007 - DNA, 538 bp, Homo sapiens
  misc_feature: GYAE6OF02ISUBP.28.57.F02.1.454.CMB.1.raw
  modified_base (479)..(479): a, c, t, g, unknown or other
  misc_feature (479)..(479): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaaataacataatattatgacaaactctgtagaagggcagattcacatctcaggacaatccaagaacacgctgtatcttacaaatgggcagcctgagagctgaacggacacgggctagtatatttacgnggtagggagagggagtacggaagttgggaacgttaggggttggtcggggaccaacgggg

SEQ ID NO: 268008 - DNA, 555 bp, Homo sapiens
  misc_feature: GYAE6OF02GM68U.28.57.F02.1.454.CMB.1.raw
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtcccgccaggcctccgaggggaacgggactgggaatagtgtctcaggtattagaagtaatgacgaataacataatattatgactaaactctgtgaagggcagattcacatcncgaggacaattccaagaacacgctgtactcttanaaatgggcaggcctagagagctagacggacacggctgtatacttacgtggtagggagaggaggtacggaagtttagggaaccgttaggggtttgggtacggggccgtaacggggg

SEQ ID NO: 268009 - DNA, 547 bp, Homo sapiens
  misc_feature: GYAE6OF02GSSCA.28.57.F02.1.454.CMB.1.raw
  modified_base (298)..(298): a, c, t, g, unknown or other
  misc_feature (298)..(298): n is a, c, g, or t
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccncaggctccgagggaaggactggaatatgtctcaggtattagaagtaatgacgaataacatatattangacaaactctagtgaagggcagatcacatctcgaggacaattaccaagaacacgctagtattcttacaaatcgggacagacctagagagacgtagacggacacggtctagtattattacgtggtaggagaggagtacggaagttacggaacgttaggggttcggtacggggacgtaacgggg

SEQ ID NO: 268010 - DNA, 596 bp, Homo sapiens
  misc_feature: GYAE6OF02IHTII.28.57.F02.1.454.CMB.1.raw
  modified_base (411)..(411): a, c, t, g, unknown or other
  misc_feature (411)..(411): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgcttatgctactgggtcccgccaggcctccgaggggaagggactggaatatgtctcgtaggtattagaagtaatgacgaataacatatattatgacaaactctagtagaagggcaagtattcaaccntcaccgaggacaattaccaagacacgctagtatacttacaaagtcgggacagcctagagacgcgtagaacggaccacggtacttaggttattacgtttacgtgggttagggacggaagggtacggacgggtaagttacgggtaaacggttagggggtttcgggtacgggggaccgtaacgggggg

SEQ ID NO: 268011 - DNA, 667 bp, Homo sapiens
  misc_feature: GYAE6OF02G31BO.28.57.F02.1.454.CMB.1.raw
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggcgtactttaaagtagtcagtgtgaggtgcagctggtggagtcgtgggggaggcttggtccagccgtggggggtccctgagactctcctgtgcagcctctggattcaccttnagttatttatgctatcgacncgtggggtccnccgaggctccagggaaggctggaatatgtctagtaggtattagaagtaatgacaataanatatatacgtntactaaaaccgtttntaggtaggaacggtatagtacttaccactacgttccgtaaccggaaggtaactaacgttaaccgaaacgaccgtacgtacttacgttacttaccgttaagaacggtcgggaccacgtacgtaggaacgtgtacggtacggaacggtacgaaccggttgttacgttacgtttaacgtttacgggtaggggaacgggaagggtaacgggtaacggtacgggtttaaagggttaacgggtaggggtttaacggggtttcggggtacggggaccggtacgggg

SEQ ID NO: 268012 - DNA, 677 bp, Homo sapiens
  misc_feature: GYAE6OF02HSSX7.28.57.F02.1.454.CMB.1.raw
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
tcagagtacgctatcacgaccggtgctcgatttagctcgatatagttggggttcgtgggagaggagcccccgccctcgggtttcccacggtggttcttcattttggttgattcagcactgcacacagaagagtcatgacggagtttgggctgagctgggttttccttgtttgctagtttttaaaggtgttaccagtgtgaggtgcagctgggtggagtcgtgggggaggcttggtccagccgtggggggtccctgagactctcctgtgcagcctntggattcaccttcagtatttangctatcgcagtcgggtccgccgacgggcctccggaggggaacgggacgtagggaatagtgtcgtctaggttattaagaagtaatgtacgtaaataacattatattagagactaaactctaggtaggaacgggcagacttacactacgtctaccgaaggaactaacgttaccaaacgaacctacgtacttacgtaacttaccttaaacgaaacgtacgggaccacggtaccgtaggaacggacgtaccgtacggaacggtactaacggttacttagttagttaagttacggtagggtacgggagggtacgggtaacggtacgggtaacggttacgggaaacgggtttacggggttacgggtaccggggtaccgtaacgggg

SEQ ID NO: 268013 - DNA, 559 bp, Homo sapiens
  misc_feature: GYAE6OF02I9UPD.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccncaggctccgagggaagggactgggaatatgtctcaggtattagaagtaatgacgaaataacatatattatgacaaactctgtagaagggcagatcacatctccaggacaataccaagaacacgctgtattcttacaaacgtgggactagcctagacgagctagacggtacacggctagtattagttacgtggtagggagacgggtagacgggtaagtttagggaaccgttaggggttacggtcgggggaccgtaacggggg

SEQ ID NO: 268014 - DNA, 554 bp, Homo sapiens
  misc_feature: GYAE6OF02FPE8I.28.57.F02.1.454.CMB.1.raw
  modified_base (350)..(350): a, c, t, g, unknown or other
  misc_feature (350)..(350): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccagccgtggggggtccctgagactctcctgtgcagcctcgtggattcaccttcagtatttatgctatgcactgggtccgccaggctccgagggaaggactggaatatgtctcaggtattagaagtaangacgaataacatatattatgacaaactctgtagaagggcagattacaccatctccgagggacaacttccaaagaacacgctagttatccttacaaagtgggacagcctgagagctagagacacggctgtatattacgtggtagggaggaaggaggaggtaagttagggaacgttaggggttcggtgggggtaccgtaacggggg

SEQ ID NO: 268015 - DNA, 538 bp, Homo sapiens
  misc_feature: GYAE6OF02IHO35.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtctgggggaggcttggtccagcctggggggtccctgagactctcctgtgcagcctctggattcaccttcagttatttatgctatgcactgggtccnccaggctccgagggaagggactggaatatgtctcaggtattagaagtaatgacgaaataacatatattatgacaactctagtagaagggcagattcaccatctaccgagggacaacttaccaagaacacgctgtatcttacaaatggacagcctgagagctagagacgagctagtatattacgtggtaggagaggaggacggtagttagggaacgttagggtaggtacggggctaacgggg

SEQ ID NO: 268016 - DNA, 608 bp, Homo sapiens
  misc_feature: GYAE6OF02IG7UE.28.57.F02.1.454.CMB.1.raw
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctggagactctcctgtgcagcctctggattcaccttcagttatttangctatgcactgggtccnccaggctccgagggaagggctaggatatgtctcgaggtattagaagtaatgacgaaatacataatattanagactaaactctaggtagaacggggcaaggtattccaaaccgtataccgtacccgagggtaaccaaagttacccaaagaacctaacgtcttagtacttaccttacaaagttgggacaggcctaggacgagcgtaggacggtacgacggtacgtagtacttaagttcgtgggtacggaggaacggtaggaacggtagttacgggtaacggttagggggttgtcggggacgtaacgggg

SEQ ID NO: 268017 - DNA, 557 bp, Homo sapiens
  misc_feature: GYAE6OF02J1DG4.28.57.F02.1.454.CMB.1.raw
  modified_base (492)..(492): a, c, t, g, unknown or other
  misc_feature (492)..(492): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccgaggcctccgagggaagggactggaatatgtctcaggtattagaagtaatgacgaataacatatattatgacaaactctgtaggaagggcagattcaccatctccgaggacaattaccaagacacgctagtactcttacaaagtcgggacagcctgagagcgtaggacgacgacggctagtattagttacgngggtgggaaggaggacggaggtaaggttagggacgttaggggttggtacggggtaccgtacgggg

SEQ ID NO: 268018 - DNA, 560 bp, Homo sapiens
  misc_feature: GYAE6OF02JEHQV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtcccgccaggctccgagggaagggactggaatatgtctcaggtattagaagtatgacgaataacatatattatgacaaactctagtaggaagggcagacttcaccatcctacagggacaattaccaaagaacacgactagtatcttacaaagtgggacagcctagagagcgtagacggacacggctagtattacgtacgtggtagggaggaggaggacggtaagttagggaacggttaggggttcgggtggggaccgtaacgggg

SEQ ID NO: 268019 - DNA, 615 bp, Homo sapiens
  misc_feature: GYAE6OF02IYYEH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtattagaagtaatgacgaataacatatattatgactaaactctgtagaagggcagtacttcaccatcctccgagggactaattccaaagaaccacgctagttacttccttacaaagtcgggacacgtcctaggaacgtagcgtaggaacggaccaacgggtcttacggtattaacgtttaccggtgggtacggggaaggtaagggtaacggtaccgggtaaagtttacggggaaaccgtttaggggggtttacgggttacggggggacccgtaagggggg

SEQ ID NO: 268020 - DNA, 653 bp, Homo sapiens
  misc_feature: GYAE6OF02HCZYA.28.57.F02.1.454.CMB.1.raw
  modified_base (507)..(507): a, c, t, g, unknown or other
  misc_feature (507)..(507): n is a, c, g, or t
tcagagtacgctatcacgaccggtgctcgatttagctcgatatagttggtcgtgggtagaggagccccgccctgggtttcccaggtgttctcatttggtgatacagcactgcactacacgaagagtcagtggacggagttttcgggctgaggctgggttttcccttgttgctatttttaaaggtgtccagtgtgaggtgcagcgtggtggagttcgtgggggacgcgttcggtccagccgtggggggtccctgacgtactcgtccgtgtcgcaggcctctggattccgacctttcagttagtttatgctatcgcaccgtgggtccgccgaggctccgagggaggactggtaactagtgtctcgaggtattagaagtactcgacgaaataacagtataattatcgtacaaactctagttaggaacgggacaagtacgttccaaccacttcctccgaaggactaacgttccaaagaccaacgctagtacttacttacaaagtcgggtanacgtcgtgacgacgcgtagacggacgtaacggtcgttacggttagttactttaacgggttggttaggggtaagtagggtaacgggtacgggtaacgtttaaggggaaccgtttaggggggtttcgttaccggggaccgtacggggg

SEQ ID NO: 268021 - DNA, 617 bp, Homo sapiens
  misc_feature: GYAE6OF02JU1QJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggacgactctcctgtgcagcctctggattcaccttcagttatttatgctatgctacgtgggtcccgccgaggcctccgagggaaggctggaatagtgtctcgaggtatagaagtaatgacgaataacatatattatgactaaactcgtagtagaagggcagacttaccaacctatccgtaccgaagggactaacgttaccaaacggaaccacgtcttagtaacttccttaacgaaagttcgggactagtcctagagcgtacgtagaacggaccgtacggcgttaggtattacgttacggtggtacgggaagtacgggtagtacggttaaggttacgggaaccggtttaggggtcggggtacggggccggtaacggggg

SEQ ID NO: 268022 - DNA, 544 bp, Homo sapiens
  misc_feature: GYAE6OF02G76EO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaaataacatatattatgacaaactctagtgaagggcagattcacatctcaggacaattaccaagaacacgctagtactacttacaaatgggacacgcctagagagctagaggacacggctagtattattacgtggtagggagagggagacggtaagttgggaacgttaggggttggtcggggaccgtacgggg

SEQ ID NO: 268023 - DNA, 537 bp, Homo sapiens
  misc_feature: GYAE6OF02I463Y.28.57.F02.1.454.CMB.1.raw
  modified_base (239)..(239): a, c, t, g, unknown or other
  misc_feature (239)..(239): n is a, c, g, or t
  modified_base (498)..(498): a, c, t, g, unknown or other
  misc_feature (498)..(498): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgngactctcctgtgcagcctctggattcaccttcagtatttatgctatgcactgggtccgccaggctccgagggaagggactggaatatgtctcaggtattagaagtaatgacgaataacatatattatgacaaactctggtagaagggcagattacacatctccagggacattaccaagaacacgactgtatcttacaatgggacacgctagagagcgtagaggacacggctagtatattacgtggtagggaggaggagnggtaagttagggaagttagggtggtcggggcgtacgggg

SEQ ID NO: 268024 - DNA, 539 bp, Homo sapiens
  misc_feature: GYAE6OF02I1P71.28.57.F02.1.454.CMB.1.raw
  modified_base (282)..(282): a, c, t, g, unknown or other
  misc_feature (282)..(282): n is a, c, g, or t
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
  modified_base (521)..(521): a, c, t, g, unknown or other
  misc_feature (521)..(521): n is a, c, g, or t
tcagagtacgctatcacgaccggtgctcgatttagctcgatataggttagggtctgggagaggagccccgccctgggtttcccaggtgttctcatttggtgatcagcactgcacacagaagagtcatgacggagtttgggctgagctgggtttccttgttgctatttttaaaggtgtccagtgtgaggtgcagctggtggagtcgtgggggaggcttggtccagccgtggggggtccctgagctctcctgtgcagcctctggacttcaccttcagtatttangctatgcactggtccncaggctccgagggaggctggaatntgtctcgaggtattagaagtatgcgaataacatagtatatgacaaactctgtagaggcagtatcacatctacgaggtacagtaccaagacacgtntagtanacttanaaagtgggactagccgtgagcgactagacgacacggcttaggtactagtacgtgggtacggagacgaggacgtaagtaggaaccgttagggnggttcgggactaacgggg

SEQ ID NO: 268025 - DNA, 584 bp, Homo sapiens
  misc_feature: GYAE6OF02HSK9D.28.57.F02.1.454.CMB.1.raw
tcagagtacgctatcacgaccggtgctcgatttagctcgatatagttgggtctggggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtggtccgccaggcctccgaggggaagggactggaatagtgtctcaggtattagaagtaatggacgtaataacatataattatgacaaactctagtgaagggctagattaccactatcctacgagggaactaacgttaccaaagaacacgcttagtactacgttacaaagtcgggtacacgtactaggagacgcgtagacggacgacggctagtattagttacgtggtagggaggtaggaaggacggtaaggttacgggtaacgttaggggtttacggtcggggacgtacgggg

SEQ ID NO: 268026 - DNA, 571 bp, Homo sapiens
  misc_feature: GYAE6OF02H3E1V.28.57.F02.1.454.CMB.1.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (379)..(379): a, c, t, g, unknown or other
  misc_feature (379)..(379): n is a, c, g, or t
  modified_base (463)..(463): a, c, t, g, unknown or other
  misc_feature (463)..(463): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctntggattcaccttcagttatttangctatgcacgtgggtcccnccaggctccgaagggaaggctaggaatatgtctacaggttaattaggaataatgacgaaataacataattaattanagacaaaatctagtaggaagggcagtattaccacaatcctaccgaaggactaaacttccgaaagaactacgcttagatccttanaaatgggacacgctagagcagtgaggaccaggtcatatactttgnggtagggtagaaggagcgggtaagttacgggaacgttaggggtttgaggggaccgtaacgggg

SEQ ID NO: 268027 - DNA, 777 bp, Homo sapiens
  misc_feature: GYAE6OF02IKHSW.28.57.F02.1.454.CMB.1.raw
  modified_base (288)..(288): a, c, t, g, unknown or other
  misc_feature (288)..(288): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgtttggtccagccgtggggggtccctggagactctcctgtgcagcctcgtggattccaccttcagttatttangctatgcacgtcgggtccgccgaggcctaccgaggggaaggtctaggaactagtgtctcgaaggttattaagaagtaatcgacgtaaataaacagttaattagtttaatggtaacctaaaacttccgttaggttacgggaaaacgggggtcctaaagggtaacttttacccgaaaccccgtaatttaccccgtaccggtaaacggggtaaacctaaacgtttaacccccgaaaaggtaaacccaccgggttacctttaaggttaacttaccgtttaacgaaaaggttccggggaacacgggttaccctgggtaaacggacggttaccgttaagggaacggtaaaccggtacgggtaccttaaggttaacttacgttttaaccggtaggggttacgggggaaaggacggggttaacggaaccgggttaagtttacggggtaaacgggttaagggggtttacgggtaccggggggtaccctaacggggggg

SEQ ID NO: 268028 - DNA, 563 bp, Homo sapiens
  misc_feature: GYAE6OF02GTCUD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggagggactggaatatgtctcaggtattagaagtatgacgaataacatatattatgactaaatctgtaggaagggcagattcaccatctccaagggtacaacttaccgaaagaaccacgactagtaattccttacaaagtggggacaggtaccctggacgagcgtggaacggacaacgggctgtattattacgtggtagggagagggagacggaagttagggaacgtaggggttaggtgggaccgtagggg

SEQ ID NO: 268029 - DNA, 554 bp, Homo sapiens
  misc_feature: GYAE6OF02FPJ9Z.28.57.F02.1.454.CMB.1.raw
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaaggactggaatatgtctcaggttattagaagtaatgacgaataacatatattatgacaaactctagtgaagggcagattcacatcncagggacaacttaccaaagaaccacgctagtattctacaagtgggacagcctagagagcgtaggaggacgacggtctagtattattacgtggtagggaggagggagtacgggaagttagggaacgttaggggttgggtacggggacgtaacgggg

SEQ ID NO: 268030 - DNA, 548 bp, Homo sapiens
  misc_feature: GYAE6OF02I46DH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgacgaataacatatattatgacaaactctgtagaagggcagattcacatctcgaggactaacttccaaagaacacgcttagtactcttacaaagtgggacagcctgagagctgacggcacggctagtatattacgtggtgggaagagggagacggtaagttcgggaaacgttaggggttcggtacgggggcctaacggggg

SEQ ID NO: 268031 - DNA, 541 bp, Homo sapiens
  misc_feature: GYAE6OF02H0W0S.28.57.F02.1.454.CMB.1.raw
  modified_base (280)..(280): a, c, t, g, unknown or other
  misc_feature (280)..(280): n is a, c, g, or t
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtccgcaggcctccgagggaagggactggaatatgtctcaggtattagaagtatgacgaataacatatattangcaaactctgtgaagggcagattcacatctcagggacaatccaagaacacgctgtatcttacaaatgggacagcctagagagcgtgaggacacggctagtatacgttacgtggtagggagaggaggacggtaagttgggaaccgttaggggttacgtcgggggaccgtaacggggg

SEQ ID NO: 268032 - DNA, 668 bp, Homo sapiens
  misc_feature: GYAE6OF02I5JVR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttcgtgtaggcgtatttaaagtaggtcagtgtgaggtgcagctggtggagtctgggggaggcttggtccagcctggggggtcctgagctctcctgtgcagcctgtggattcaccttcatatttatgctatgcacgtcggtccgccgacggctgacccccgggagggacgtggaatagtgtctcaggtagttagaagtaatgacgtaaataacatatattatgtacaatctagtgagggtacagtattacactactcgtaccgaggaactaacgttaccgaaacgacgtaccgtacgtagttacgttaccttaacgtaaacgtgggaccgtaacgtacccgttagacggtaacgtacgtacggaaacgggtaccgtacgggtaccgttagttagtttaacgtttaccggtaacgggttaacggggaagggtacgggtaagggtaccggggttaagttagggggttaaaccggtttagggggtttacggggttacgggggacccgggttaaccgggggg

SEQ ID NO: 268033 - DNA, 533 bp, Homo sapiens
  misc_feature: GYAE6OF02G00Q8.28.57.F02.1.454.CMB.1.raw
  modified_base (447)..(447): a, c, t, g, unknown or other
  misc_feature (447)..(447): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggagggactggatatgtctcaggtattagaagtatgacgaataacatatattatgacaaactctgtagaagggcagattcacatctcaggacaattccaagacacgctagtatcttacaaagtgggacagcctagagngctgaggacacggctgtatattacgtggtagggagagggagacggtaagttgggaacgttggggttcggtgggggaccgtacgggg

SEQ ID NO: 268034 - DNA, 545 bp, Homo sapiens
  misc_feature: GYAE6OF02GNITN.28.57.F02.1.454.CMB.1.raw
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (419)..(419): a, c, t, g, unknown or other
  misc_feature (419)..(419): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgagggaagggactggaatatgtctcgaggtatagaagtatgacgaataacatatattangacaaactntgtagagggcagatcaccatctcgaggacattaccaagacacgntagtatcttacaatcggacacgcctgagagcctagacggacacggctagtatagttacgtggtagggaagagggtagacggtaaagttcgggaacgttaggggttggtacgggggactaacggggg

SEQ ID NO: 268035 - DNA, 554 bp, Homo sapiens
  misc_feature: GYAE6OF02GUKDS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggaagggactggaatatgtctcaggtattagaagtaatgacgaataacataatattatgactaaactctaggtgaagggcagattcaccatcctcgaagggacaattaccaagaacacgctagtactcttacaaatcgggacagcctagacgagcgtagaaggacaacggctagtatagttacgtggtagggagaggagaggtaagttggaacgttaggggttggtaggggaccgtacgggg

SEQ ID NO: 268036 - DNA, 584 bp, Homo sapiens
  misc_feature: GYAE6OF02IHONR.28.57.F02.1.454.CMB.1.raw
  modified_base (373)..(373): a, c, t, g, unknown or other
  misc_feature (373)..(373): n is a, c, g, or t
  modified_base (479)..(479): a, c, t, g, unknown or other
  misc_feature (479)..(479): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtcgggtccgccaggctccgaggggaacgggactggaatatgtctcgaggtattagaagtaatgacgaataacatatattanagacaactcgtgtaggaagggcagtattccacacgtactacgaagggactaactaccaaacgaacgacgtactagtactcttaacgaagtgggcagccgtagacgngtacgtgaacggacgacggcgtagtatacgttacggtggtagggagagggagtacgggtaggttaggtaacggttggggttagggtacggggaccggtaacgggg

SEQ ID NO: 268037 - DNA, 562 bp, Homo sapiens
  misc_feature: GYAE6OF02F52U5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccgccaggctccgagggaagggactggaatatgtctcgaggtattagaagtaatgacgaataacatatattatgactaaactctaggtagaagggcagtattacacatctcgaagggacaacttaccaagaacacgctgtatctacaatgggacagcctagagagcgtaggagacacgctagtatattacgtggtagggaaggagggaggtacgggtaattacggggaaacggttaggggtttacggtacggggacggtaacggggg

SEQ ID NO: 268038 - DNA, 557 bp, Homo sapiens
  misc_feature: GYAE6OF02GGDX5.28.57.F02.1.454.CMB.1.raw
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtggtgaggtgcagctggtggagtctgggggaggcttggtccagcctggggggtccctgagactctcctgtgcagcctctggattcaccttcagtatttatgctatgcactgggtccgccaggctccgaggggaagggactgggaatatgtctcaggtattagaagtaatgacgaataacatatattatgacaaactctgtagaagggcagattcaccatctacaggacaattaccaagaacacgctgtactcttacaaatgggacagcctagagacgcgtaggacgacgacggnttagtattacttacgtggtagggaggaggagacgggtaagttacgggtaacgttaggggttggtacggggacgtaacggggg

SEQ ID NO: 268039 - DNA, 667 bp, Homo sapiens
  misc_feature: GYAE6OF02IQ1DJ.28.57.F02.1.454.CMB.1.raw
  modified_base (287)..(287): a, c, t, g, unknown or other
  misc_feature (287)..(287): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggagcttggtccagccgtggggggtccctggacgtacctctcctgtgcagcctctggacttcgaccttcagttatttangtctatcgacncgtgggtcccnccgaggtcctaccgagggaacggactggaatacgtcgtacgtacgtaggttaacttaggaagttaagtcgacgtaaataacgtataacttagttagagtactaaactcgtagtcggtaacgggtctacgtaacttaccgacttagtaccgtaccggaaggtactaacgtaccaagtaccacgtacttacgtacttacgttacgaaagttccgggactacggtacctaggtaacgtacgtacgttacggacgggtaccacgggttacgttacgtattacgttacggcggttaacgggagtacggtagtacgggttaagttcggtaacggttgggttacggtaccggggaccgtacgggg

SEQ ID NO: 268040 - DNA, 546 bp, Homo sapiens
  misc_feature: GYAE6OF02HQ72I.28.57.F02.1.454.CMB.1.raw
  modified_base (366)..(366): a, c, t, g, unknown or other
  misc_feature (366)..(366): n is a, c, g, or t
  modified_base (447)..(447): a, c, t, g, unknown or other
  misc_feature (447)..(447): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattccaccttcagtatttatgctatgcactgggtccgcaggctccgaggggaagggctggaatatgtctcaggtattagaagtaatgacgaataacatatattangacaaactctgtgaagggcagattcactatcacgaggacaatcaagaacacgactgtattctacaatgggacagcctgagngctagaacggacacggtctagtatacgttacgtggtaggggaagagggagacgggtaagttgggaaacggttaggggttaggtagggggcctaacgggg

SEQ ID NO: 268041 - DNA, 553 bp, Homo sapiens
  misc_feature: GYAE6OF02I5YU3.28.57.F02.1.454.CMB.1.raw
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccagggcctccgagggaagggctggaatatgtctcaggtattagaagtaatgacgaataacatatattatgacaaactctagtagaagggcagtattcaccatctaccgagggaccaattaccaagaacacgctgtatcttacaatgggacagctgagagctgacggcacggntagtatagtacgtggtagggtaggaggaggtacggtaagttcgggaaacgttaggggttcgggtacggggaccgtaacggggg

SEQ ID NO: 268042 - DNA, 589 bp, Homo sapiens
  misc_feature: GYAE6OF02F8UR1.28.57.F02.1.454.CMB.1.raw
  modified_base (389)..(389): a, c, t, g, unknown or other
  misc_feature (389)..(389): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgagggaaggctggaatatgtctcgaggtattagaagtatgacgaataacatatattatgacaaactctagtaggaacgggnagattacaccgatcctaccgaagggtacaacttaccaaagaaccacgctagttaactccttacaaagtcggggacagaccgtgaacgagtactaggacggaaccacgggtctagttacttaagttacgttggtagggaagtaaggaggacgggtaatttcgggaaccgttaggggttcggtacgggggacctaacggggg

SEQ ID NO: 268043 - DNA, 255 bp, Homo sapiens
  misc_feature: GYAE6OF02JAVNQ.28.57.F02.1.454.CMB.1.raw
  modified_base (224)..(255): a, c, t, g, unknown or other
  misc_feature (224)..(255): n is a, c, g, or t
tcagagtacgctatcacgaccggtgctcgatttagctcgatataggttgggttgtggggccagggagccctggtcaccggtctcctcagccctccaccaagggcccatcggtcttccccctggcgccctgctccaggagcacctccgagagcacagcggccctgggctgcctggtcaaggctacttccatagcgtactctgagcgggctggcaaggcgcatagnnnnnnnnnnnnnnnnnnnnnnnnnnnnnnnn

SEQ ID NO: 268044 - DNA, 528 bp, Homo sapiens
  misc_feature: GYAE6OF02IIMM2.28.57.F02.1.454.CMB.1.raw
  modified_base (298)..(298): a, c, t, g, unknown or other
  misc_feature (298)..(298): n is a, c, g, or t
  modified_base (402)..(402): a, c, t, g, unknown or other
  misc_feature (402)..(402): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagcctggggggtccctgagactctcctgtgcagcctctggattcaccttcagttatttatgctatgcactgggtccnccaggcctccgaggggagggactggaatatgtctcgaggtattagaagtaatgacgaataacatatattatgacaaactctagtgaagggcagattccacatcncgaggaacaatccaagaacacgntntatcttacaaagtggcagcctagagagcgtgagacacggntgtatattagnggtaggagaggngaggtaagttggaacgtagggtcggtggggctacgggg

SEQ ID NO: 268045 - DNA, 561 bp, Homo sapiens
  misc_feature: GYAE6OF02HET5I.28.57.F02.1.454.CMB.1.raw
  modified_base (300)..(300): a, c, t, g, unknown or other
  misc_feature (300)..(300): n is a, c, g, or t
  modified_base (398)..(398): a, c, t, g, unknown or other
  misc_feature (398)..(398): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtcccnccaggcctccgaggggaaggactggaatatgtctcaggtattagaagtatgacgaataacatatattatgacaactctgtagaaggcagatcacatcncgaggacaactacaagacacgctagtatcttacaaagtgggcacgcctagacgagcgtaggacggaccacggcttagtattagttacggtggtagggaagtaagggaggtacgggtaagttagggaacgttagggggttaggtacgggggaccgtaacggggg

SEQ ID NO: 268046 - DNA, 527 bp, Homo sapiens
  misc_feature: GYAE6OF02IXQYL.28.57.F02.1.454.CMB.1.raw
  modified_base (442)..(442): a, c, t, g, unknown or other
  misc_feature (442)..(442): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtatagaagtatgacgaataacatatattatgacaactctgtagaagggcagatcacatctcaggacataccaagacacgctgtatcttacaagtgggcagcctgagngctgagacacggctgtatattacgtggtaggagaggacgaggtaagttgggtaacgttaggggttcggtcggggaccgtaagggg

SEQ ID NO: 268047 - DNA, 652 bp, Homo sapiens
  misc_feature: GYAE6OF02IZOXX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgttagctatttaaggtgtcagtgtgaggtgcagctggtggagtcgtgggggaggcttgggtccaggcctgggggggtccctggagactctcctgtgcagcctctggattcaccttcagttatttatgctatgcactgggtccgcaggctccgaggggacggactgggaatatgtactcgaggtattaacgaagtaatgacgtaataacatatattactgactaaactctagtaggaagggtcaagtacttaccaccctattacccctaccgaacggggtaacaaactttaccgaaacgtaaaccgaaccggtctttagttaactttccttaactaaacgttcggggactaacggtccctaggaagtacggtactaggacggaacgtaccgggtattggttaattacgtacggttgggttaagggacggtaagggacggtaagggtaagtttacggtaacgggttaaggggttcgggttaacggggccgtaacggggg

SEQ ID NO: 268048 - DNA, 680 bp, Homo sapiens
  misc_feature: GYAE6OF02ISR7P.28.57.F02.1.454.CMB.1.raw
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcacctttcagttatttatgcttatgcactgggtccnccaggctccgagggaggactggaatatgtctcaggtatagaagtangacgaaataacatatattagtgactaaactctagtagaagggcaagtacttcgaacctattctaccgaggggtaacctaaacgttaccaaacggaaacctacggactttacggttaacttacccgtttacgaaaacgttcgggacctaacggtacccgttagaacggtaggtaccgttacgggaacgggtaaccgaccggggtaccgttaggttaactttaacgtttaaccggttggggttacggggaagggtaacgggacgggtaaccgggttaaaggtttacggggaaacggtttacgggggtttgggtaccggggggtaccgtaacgggggg

SEQ ID NO: 268049 - DNA, 557 bp, Homo sapiens
  misc_feature: GYAE6OF02H5Q3I.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcacctttcagtatttatgctatgcagtgggtccnccaggctccgagggaaggactggaatatgtctgaggtattaagaagtaatgacgaataacatatattatgactaaatctgagaggcagtatcacatctaccgaggactaattccaaagacacgctagtactacttacaaagtggcagtcctagagacgctggaggaccgacgtcgtgttattattacgtggtagggtaggaagggacgaggtaagttagggaacgttaggggtttggtaccggggacgtaacggggg

SEQ ID NO: 268050 - DNA, 572 bp, Homo sapiens
  misc_feature: GYAE6OF02F4M89.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtccgccaggcctccgaggggaagggactggaatatgtctcgaggtattagaagtaatgacgaataacatatattatgacaactctgtaggaagggcagacttaccactatcctaccgagggacctaacgttaccaaagaacacgctgtactccttacaaagttcgggacacgccgtagacgagcgtaggacgacgacggctagtattattacggtggtagggagaggaggtacggagttagggaacggttaggggtggtacggggaccgtacgggg

SEQ ID NO: 268051 - DNA, 576 bp, Homo sapiens
  misc_feature: GYAE6OF02JENEN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgttggggtcccgccgaggctccgaggggaagggactggaatatgtctcgaggttattaaggaagtaatgacgaaataacattatattatgacaaactctagtagagggcagattcaccatctaccgaggacaattaccaagaacacgctagtactacttacaaagtcgggcacgacctagagagacgtgaaggtacgacggtctagttactagttacgtgggttagggaggtaggaggacggtaagttcgggtaacgttaggggttacggtggggaccgtaacgggg

SEQ ID NO: 268052 - DNA, 630 bp, Homo sapiens
  misc_feature: GYAE6OF02HUDBI.28.57.F02.1.454.CMB.1.raw
  modified_base (299)..(299): a, c, t, g, unknown or other
  misc_feature (299)..(299): n is a, c, g, or t
  modified_base (540)..(540): a, c, t, g, unknown or other
  misc_feature (540)..(540): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtattttatgctatgcactggggtccnccgaggcctccgaggggaacgggctaggaatagtcgtctcgaggttattagaagtaagtgacgtaaataacatataattatagacaaaacttctaggttaggaagggcagtacttcaaccattccaccgagggaactaacttccaaagaacacgtctagtactccttaacaaagtcgggtacacgtcctagacgagtccgtaggacggacacgggtacttagtactttagttcggttaggngggggtaacgaaggggtacgggtaccgggtaaagtttacggggaaaccgtttaggggggtttcggtacggggggtacccgtaacgggggg

SEQ ID NO: 268053 - DNA, 576 bp, Homo sapiens
  misc_feature: GYAE6OF02GL2F3.28.57.F02.1.454.CMB.1.raw
  modified_base (506)..(506): a, c, t, g, unknown or other
  misc_feature (506)..(506): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccaggccgtggggggtccctgagactctcctgtgcagcctctggattcaccttcagtatttatgctatgcactgggtcccgccaggctccgaggggaaggactgggaatatgtctcgaggtattagaagtatgacgaaataacataatattatgacaaactctggtagaagggcagtatcaccatctaccgaggacaattaccaaagaacacgtctagtactacttacaaagtgggacaggacctgaacgagcgtaggacggacgacggctgtactagtttacgnggtagggaagtagggaggacgggtaagttcgggtaaacgttggggttcggtagggggaccgtaacggggg

SEQ ID NO: 268054 - DNA, 677 bp, Homo sapiens
  misc_feature: GYAE6OF02HETJ1.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtcgtgggagaggagcccccgccctcgggtttcccaggtgttctcatttggtgatcagcactgcacacagaagagtcatgacgggagtttgggctgagctgggttttccttgttgctattttaaaggtgtccagtgtgaggtgcagctggtggagtcgtggggggaggcttgggtccagccgtgggggggtccctgagactctcctgtgcagcctctggattccaccttcagtatttatgctatgcactgggtcccncaggcctccgaaggggaagggctggaatatgtctctagggtattaagaagttaatgacgaaataacattataattatgacaaaacttctaggtaggaaaggggtcaagtatttccaaccctagttccttacccggaaaggggtaactaaacttacccgaaaaggaacccaacggtcgttacgttaataccgtttaacaaaagtcggggtacaaccggtccttagggataacggcttaggaacggaccgacgggtctaaggttacttaatttaccggtggtaggggggtacaaaggggtacgtaagggttaacggtttacggggaaacggttttaaggggggttcgggtccggggggaacccgtaagggggg

SEQ ID NO: 268055 - DNA, 533 bp, Homo sapiens
  misc_feature: GYAE6OF02FY3BI.28.57.F02.1.454.CMB.1.raw
  modified_base (494)..(494): a, c, t, g, unknown or other
  misc_feature (494)..(494): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgagggagggactgggaatatgtctcaggtattagaagtatgcgaataacatatattatgacaaactctgtagaagggcagattcacatctccaggacaattccaagacacgctgtatcttacaaatgggactaggcctgagagctagacgacacggctagtatagttacgtggtgggacgagggagnggaagtttggaacgttagggttggtggggacctaagggg

SEQ ID NO: 268056 - DNA, 607 bp, Homo sapiens
  misc_feature: GYAE6OF02HCXCW.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccnccaggcctccgagggaagggactggaatatgtctcgaggtattagaagtatgacgaataacataatattatgactaaactctagtaggaagggcagtattccgactatcctaccgagggactaacttaccaaagaaccacgtctagtattccttacaaagttcgggacaggtcccgtagacgacgtcgtaggaacgggacacgggtcttagtagttacgtttacgtgggtaggggtaagaggggtacggacgggtaaggtttacgggaacggttagggggtttacggtagggggacccggtaacggggg

SEQ ID NO: 268057 - DNA, 564 bp, Homo sapiens
  misc_feature: GYAE6OF02HC91U.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaaggctggaatatgtctcaggtattagaagtaatgacgaataacatatattatgacaaactctgtagaagggcaagattcaccatcctcgagggacaattccaaagaacacgctagtatcttacaaagtgggacagcctgaagagtcgtagacggacacgggtctggtacttaagttacgtggttagggaggtaaggaggacgggtaagtttaggggaacgttaggggttcggttagggggaccctaaggggg

SEQ ID NO: 268058 - DNA, 579 bp, Homo sapiens
  misc_feature: GYAE6OF02G8OPV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctcgtggattcacctttcagttattttatgctatgcacgtcgggtccgccaggcctccgaggggaagggactgggaatagtgtctacgaggttattagaagtaatgacgtaataacattataattatgactaaactctagtagaagggcagtattaccactattccaccgaggaactaacttccaaagactacgctagtactcttacaaagtcggacacgtcctgagatacgtgaacggcacgggcttagtatacttacgtggtaggaggaggtacgacggtaagtcgggtaagttaggggtcggtacggggactacgggg

SEQ ID NO: 268059 - DNA, 615 bp, Homo sapiens
  misc_feature: GYAE6OF02H4KHU.28.57.F02.1.454.CMB.1.raw
  modified_base (255)..(255): a, c, t, g, unknown or other
  misc_feature (255)..(255): n is a, c, g, or t
  modified_base (283)..(283): a, c, t, g, unknown or other
  misc_feature (283)..(283): n is a, c, g, or t
  modified_base (370)..(371): a, c, t, g, unknown or other
  misc_feature (370)..(371): n is a, c, g, or t
  modified_base (426)..(426): a, c, t, g, unknown or other
  misc_feature (426)..(426): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtcccctgagactctcctgtgcngcctctggattcaccttcagttatttangtctatgcacgtgggtccgccaggctccgagggaaggactggaatgtgtctcgaggtatagaagtaatgacgaataacatatattannacaactctgtagaggcagtatcactatctacgaggactaattaccaagaaccacncttagtacttacttacaaacgtgggtacacgtcctaggaagagtaccgtaggaccggacgtaacgggtcttaggtaacttacgtttacgtaggggttacgggaggtaagggtacgggtaccgggttaaaggtttacgggaaacggtttacgggggttttacggtacgggggggtacccgtaacgggggg

SEQ ID NO: 268060 - DNA, 544 bp, Homo sapiens
  misc_feature: GYAE6OF02GOSOY.28.57.F02.1.454.CMB.1.raw
  modified_base (298)..(298): a, c, t, g, unknown or other
  misc_feature (298)..(298): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
  modified_base (462)..(462): a, c, t, g, unknown or other
  misc_feature (462)..(462): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccnccaggctccgagggaagggactaggaatatgtctcgtaggtattagaagtatgacgaaataacatatattatgacaaactctgtagaagggcagattcacctatcctacgaggacaacttaccaaagaacacgctagtactctacaaagtggcagccngagngntagagacaggctagtattagtacgtggtagggagaggaggagtaagttgggtaaacgttgggtaggtcggggacgtacgggg

SEQ ID NO: 268061 - DNA, 559 bp, Homo sapiens
  misc_feature: GYAE6OF02HF3SM.28.57.F02.1.454.CMB.1.raw
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (466)..(466): a, c, t, g, unknown or other
  misc_feature (466)..(466): n is a, c, g, or t
  modified_base (482)..(482): a, c, t, g, unknown or other
  misc_feature (482)..(482): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttangctatgcacgtgggtccnccaggcctccgagggaagggactagggaatagtgtctcgaggttattagaagtatgacgaaataacataatattatgactaaactctagtagaagggcagattcaccatctacgaggacaattccaaagaacacgctagtattcttacaaagtcggcagccagagngtcgtagagacacggntgtatagttacgtggtagggagagggaggtcggtaagttcggaaacgttaggggttgggtacggggccgtaacgggg

SEQ ID NO: 268062 - DNA, 544 bp, Homo sapiens
  misc_feature: GYAE6OF02HKP8V.28.57.F02.1.454.CMB.1.raw
  modified_base (281)..(281): a, c, t, g, unknown or other
  misc_feature (281)..(281): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcacctttcagtatttangctatgcactgggtccgccaggcctccgaggggaagggactggaatatgtctcaggtattagaagtaatgacgaataacatatattatgacaaactctagtagaagggcagattcacatctcaggacaattccaagaacacgctagtactcttacaaagtgggacagcctgagagcgtgaaggacacgggctagtatattacgtggtagggagaggaggacggtaagttagggaacgttaggggttggtggggcctaacgggg

SEQ ID NO: 268063 - DNA, 570 bp, Homo sapiens
  misc_feature: GYAE6OF02ITVED.28.57.F02.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttangctatgcacgtgggtccnccaggcctccgaggggaacgggactggaatagtgtctcgaggtattagaagtatgacgaataacatatattatgactaaatctgtagagggcagtattcacatctcgaaggactaattaccaaagaaccagtctagtaactcttacaaagtgggacagcctagagacgactgaacggacgaacggcttaggtattaattacggtggtagggagtaagggaggtacggtaagtttgggaacgttaggggttcggtaggggccgtaacggggg

SEQ ID NO: 268064 - DNA, 659 bp, Homo sapiens
  misc_feature: GYAE6OF02GU3JY.28.57.F02.1.454.CMB.1.raw
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtggtttccgtgttaggctatttttaaaggtgtccagtgtgaggtgcagctggtggagtctgggggagcttggtccagccgtggggggtccctgagactctcctgtgcagcctctggattccaccttcagttatttangctatgcacttcgggtccgccgaggccttcccgaagggggaaggggtacgtagggaaattagtcgtctcgtaaggttattaagaagtaatgacgaataacatatattatgactaactntgtaggaggacaggtacttaccgaactctcctaccgaacgggaactaaacgttaccgaaagaaccacggtcttacgttacttacgttacaaaggttcggacgtaacgaccgttggaacgaacgcgttacgggaacggtacgtaaccggtagttacggttattacgtttaacgtggggtaagggtacgggaagggtacggtacgggtaagtttaacggggtaacgttaggggttcggggtacggggacgtaacggggg

SEQ ID NO: 268065 - DNA, 547 bp, Homo sapiens
  misc_feature: GYAE6OF02GAST7.28.57.F02.1.454.CMB.1.raw
  modified_base (304)..(304): a, c, t, g, unknown or other
  misc_feature (304)..(304): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagccgtggggggtccctgagactctcctgtgcagcctctggattcacctttcagttatttatgctatgcactggggtcccnccaggctccgaggggaagggactggaatatggtctcaggtattagaagtaatgcgaataacatatattangacaaactctgagaggnagattcacntcncaggacaattacaagacacgctgtatctanaatggacagcctgagacgcgtaggacgacgacggctagtattacttacgtggtagggaggaggaggacggtaagttcgggtaacgttaggggtttggtggggaccgtaacgggg

SEQ ID NO: 268066 - DNA, 586 bp, Homo sapiens
  misc_feature: GYAE6OF02FQO9J.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcccgtgggggggtccctggagactctcctgtgcagcctctggattcaccttcagtatttatgctatgcactgggtccgccaggctccgagggaagggacgtggaatatgtctcgaggtattagaagtaatgacgaataacatatattatgacaactctgtagaagggcagtacttacaccatctaccgagggactaattaccaaagaacaacgctagtacttcttacaagtgggcagcctaggagagcgtagacggaccagggtctagtacttagttacgttggtggggaagagggacggtacgggtaagtttaggggaaaccgtttagggggtttcgggtacgggggacccggtaacggggg

SEQ ID NO: 268067 - DNA, 667 bp, Homo sapiens
  misc_feature: GYAE6OF02IXGL3.28.57.F02.1.454.CMB.1.raw
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgttcgtgtaggctatttaagtagtcagtgtgagtgcagctggtggatcgtgggggagtcttggtccagccgtggggggtccctgagtctctcctgtgcagtcctgtggacttcctaccttnagttatttatgctatgctcgtgggtccgcaggctccgaggggaaggactggaatgtggtcctagagtatagaagtatcgacgaaataanataattattancgaactaactcgtgtaggaggcagtatccacatcctacgacggtaactaacgttacgaaagtaaccacgtacttagtaactttccgttaacgaaacgtcggggactaaccggtacctaggggaacgtacggtaccgttagggaaccggtaaacggtaccgggttacgttagggtttaactttaagttttaccggaaggggttacgggggaaagtacggggtaacggttacgggttaaagttacgggggttaaaccgtttaggggggtttcgggtaccggggggacgttaaccgggggg

SEQ ID NO: 268068 - DNA, 664 bp, Homo sapiens
  misc_feature: GYAE6OF02HVTXS.28.57.F02.1.454.CMB.1.raw
  modified_base (457)..(457): a, c, t, g, unknown or other
  misc_feature (457)..(457): n is a, c, g, or t
  modified_base (499)..(499): a, c, t, g, unknown or other
  misc_feature (499)..(499): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcaccttcagttattttatgcttatgcacgttgggtccgccaggcctccgaggggaaggacgtggaatatgtctcgaggttattagaagtaatgacgaataacattataattatagactaaacttctaggtaggaagggcagtacttcacctatccacgagggactaacttaccgaagaaccaccgacttntacttaccttaacgaaagttcgggactacgccgttggaacgnggtaccttagggaacgggaaccctacggggtactttacggttaagttaaccgtttacggtaggggtttaggggaagggtaagggtacgggaaccgggttaagtttacggggtaaaacgggtttaggggggttttccgggtacgggggggacccgtaacggggggg

SEQ ID NO: 268069 - DNA, 739 bp, Homo sapiens
  misc_feature: GYAE6OF02F2XPF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtagctattttaaagtgtcagtgtgaggtgcagctggtggagtctgggggaggcttggtccagccgtggggggtccctgagactctcctgtgcagcctcgtggattcaccttcagtatttatgctatgcacgtgggtccgcacggctccgaggggaagggactggaatatcgtctcgtaggtattagaagtaatgacgtaataacatattattatgactaaacttctggtaggaagggcaaggtactttaccaaccgtacttccgtaccggtaaagggaaccttaaacgtttacccaaaacgggaaacccacggttacttaggttaacctttccgttaaaccgtaaaaggttcggggaacctaacggtacccgttaggaaccggtaggtccgtaacggggaaacgtacccggtaacgggtccgtttaaggttaactttaagttaaccgggtttagggggttagggggaaacgggtaacgggggtaacgggtaaccggggttaaaggttttaaccgggggaaaaccgggtttttaggggggggtttaccggggttaccggggggggaaccccgttaagggggggg

SEQ ID NO: 268070 - DNA, 573 bp, Homo sapiens
  misc_feature: GYAE6OF02I8PP3.28.57.F02.1.454.CMB.1.raw
  modified_base (283)..(283): a, c, t, g, unknown or other
  misc_feature (283)..(283): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagcctgggggggtccctgagactctcctgtgcagcctctggattcaccttcagtattttangctatcgcactgggtccgccgaggctccgaggggaagggactggaatatgtctcgaggtattagaagtaatgacgaataacatatattatgacaaactntgtggaagggcagnttacacatcgcagggacaataccaagacacgctgtatctacaagnggacncgcctagagagctagaggacgacggnttacggtattagtttacggtgggtacgggaaggacgggaaggtacgggtaagttaggggtaaaccgttgggggttacgggtacggggaccggtaacggggg

SEQ ID NO: 268071 - DNA, 533 bp, Homo sapiens
  misc_feature: GYAE6OF02F9PC0.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggaatttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccagggaaggactggaatatgtctcaggtattagaagtaatgacgaataacatatattatgacaaactctgtgaagggcagattcaccatctccagggacaattccaagaacacgctgtatcttacaaatgggacagcctgagagctgaggacacggctgtatattacgtggtgggagaggagacgggtaattgggaacgttaggggttcggtaggggccgtaacgggg

SEQ ID NO: 268072 - DNA, 566 bp, Homo sapiens
  misc_feature: GYAE6OF02G3THN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggcctccgaggggaacgggactagggaatatgtctcaggtattaagaagtaatgacgaataacattaatattatagactaaactctagtaggaagggcagtattaccacctatcctaccgagggactaagttaccaaagaacacgctagtactcttacaaagtcgggacagcctagagagctagaggacacgtctagtatagttacgtggtagggagaggagacggtagttagggaacgttaggggtggtacggggactaacgggg

SEQ ID NO: 268073 - DNA, 610 bp, Homo sapiens
  misc_feature: GYAE6OF02FFQSZ.28.57.F02.1.454.CMB.1.raw
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtagcagcctctggattcaccttcagttattatgctatgcacgtggtccgcaggctccgagggaggactggaatntgtctcgagtatagaagtangacaatacatatatatgacaactctgtaggaaggcagtattcacgtactccgtacgaaggactaacttaccgaaagaccacgtctagttactactaacgaaacgtcgggactacggtaccgtaggacgagacgtaaggacggtaacgacggtacttagttacgtaacgttacggtagggtaccgggaaggtaacgggtacggaacggttaaggttacgggttaaaccggttggggttacggggtaccggggtaccggtacccggggg

SEQ ID NO: 268074 - DNA, 621 bp, Homo sapiens
  misc_feature: GYAE6OF02G5YYD.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagtatttatgctatgcacgtgggtccnccgaggcctccgaggggaaggcgtaggaatatgtctcgaggtattaagaagtatgacgtaataacattatattatgacaaacttctagtaggaagggcagtattacacctatcctacgagggactaacgttaccaaagaaccacgtacgtagttaacttacttaacgtaaagtcgggacctagtacccgttaggaacgaggtaccgtagggaacggaccgacgggcttaggttattacgtttacgtgggtagggacggtaggacggtacgggtaagtttacgggaacggttaggggttgggtacggggacgtaacggggg

SEQ ID NO: 268075 - DNA, 835 bp, Homo sapiens
  misc_feature: GYAE6OF02HKSON.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttgggtccagccgtggggggtccctgagactctcctgtgcagcctctggattcaccttcagttatttatgctatgctacgtcggggtcccnccgaggcctaccggaaggggaacgggactagggaattagtgtctacgtaaggttattaaggaaagtaatcggacgtaaaattaactaattaagtttaatttaatacggtaacctaaaacgtttcgtagggtaacgggaaacggggtactaaggtaactttacccaaacccgtacgttacccgtaacccggaaacggggtaaacccttaaaccgtttaaccccgaaaaagggtaaaccctaaccggttaaccgtttaggttaaacctttacccgtttaaacgtaaaacggttccgggggaacctaaccgggtaccccgttagggaaacggtacggtaccggttacgggaaaccgggtaaccgaaccggggttacgtttacggttaaacggtttaacgtttaaccgggttaggggttagggggtaaacggtaaggggtaaccgggtaacggggttaaggttttaacgggggaaaccggttttaggggggggtttacgggtacccggggggtaacccgggtaaacgggggg

SEQ ID NO: 268076 - DNA, 655 bp, Homo sapiens
  misc_feature: GYAE6OF02IWBFW.28.57.F02.1.454.CMB.1.raw
  modified_base (536)..(536): a, c, t, g, unknown or other
  misc_feature (536)..(536): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcgttggtccagccgtggggggtccctgagactctcctgtgcagcctctggattcaccttcagttatttatgctatgctacgtcgggtccgccgaggcctccgaaggggaacgggactaggaatagtgtctacgtaggtaattaggaaagttaagtcgacgtaaataactataattattaatgactaaactctaggtacggaagggctagtacttaccgaacctaagttcctaccggaagggaactaaacgttaccaaaacgaactaccgacttaggttaacttaccttacgaaaagtcgggaaccacggtacccgtagaacgnggtaccgtgggtaacgacgtacggtcttaggttattaggttacgtgggttagggaaggagggacggtaggtaacggttacggaacggttaggggttcgggtaggggaccgtaacggggg

SEQ ID NO: 268077 - DNA, 532 bp, Homo sapiens
  misc_feature: GYAE6OF02GWILM.28.57.F02.1.454.CMB.1.raw
  modified_base (473)..(473): a, c, t, g, unknown or other
  misc_feature (473)..(473): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggagggactggaatatgtctcaggtattagaagtaatgacgaataacatatattatgacaaactctgtgaagggcagattcaccatctccagggacaattccaagaacacgctgtatcttacaaatgggcacgcctgagagctgaggacacgctgtatattacgnggtagggagagggagtagggaattgggaacgttaggggttggtcgggggactaacgggg

SEQ ID NO: 268078 - DNA, 524 bp, Homo sapiens
  misc_feature: GYAE6OF02FT89M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactggtccgcaggctccagggaaggactggaatatgtctcaggtattagaagtaatgacgaataacatatattatgacaaactctgtagaagggcagattcacatctcagggacaacttccaagaacacgctgtatcttacaaatgggcagcctagagagctgagacacgctgtatattagtggtagggagaggagacggtagttagggaacgttagggtggtaggggcctaacgggg

SEQ ID NO: 268079 - DNA, 589 bp, Homo sapiens
  misc_feature: GYAE6OF02FV967.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcacctttcagttatttatgctatgcactgggtccgcaggctccgagggaggactggaatatgtctcaggttatagaagtatgacgaataacataatattatgactaaactctaggtaggaagggcagtattcaccatctaccgagggacctaaacttaccaaagaaccacgtactagttataccttacaaacgttcgggacacgtcctaggagacggcgttaggaacggacgacgtctagttatagttacgtggtagggaggagggacggtaggtaagttacgggtaaccggttaggggttcggtacgggggtccgaacggggg

SEQ ID NO: 268080 - DNA, 752 bp, Homo sapiens
  misc_feature: GYAE6OF02F0ARJ.28.57.F02.1.454.CMB.1.raw
  modified_base (746)..(746): a, c, t, g, unknown or other
  misc_feature (746)..(746): n is a, c, g, or t
  modified_base (750)..(750): a, c, t, g, unknown or other
  misc_feature (750)..(750): n is a, c, g, or t
  modified_base (752)..(752): a, c, t, g, unknown or other
  misc_feature (752)..(752): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaaagaacacgctgtatcttacaaatgggcagcctgagagctggaggacacggctagtatattactggtgggagaggagcggaagtttggaacgttagggggttggtgggggacccgaaggggacgcccgtgggtacctacccggtctcccgtcgaacggtccccttacccgaaacccgaacggggtcccccaacgttcccggttacccgtttcccccccggtacgggccccgtcccccgttacggccccgttaccccggacggggtaccgtaccccgaaccccgttacccggaacggaacgacccgaaccgtaaccgggcccgggtccccggttacgggggtcccgttaccggtccccggtttcggggttaacccggtaaacggggttaaccctttaaacccgtttcccgtaaacgttaccggttacccgtttaaccgttccggtaccgggtaacgggtcccgggggtacgtacggggacccgtaacggggccgtaacggaagttacggngcgngn

SEQ ID NO: 268081 - DNA, 567 bp, Homo sapiens
  misc_feature: GYAE6OF02ITRXZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcacctttcagtatttatgctatgcactgggtccgccaggcctccgagggaagggactgggaatatgtctcaggtattagaagtaatgacgaataacatatattatgacaaactctagtgaagggcagtattcacatctcgaggacaattccaaagacacgctagtactcttacaaatgggcagcctagagacgctagacggaacacgggtctagttattattaccgtggtacggggaagagggtaggacgggtaattacggggaaccgttagggggtttcggtcggggggaccctaacggggg

SEQ ID NO: 268082 - DNA, 563 bp, Homo sapiens
  misc_feature: GYAE6OF02G8WTZ.28.57.F02.1.454.CMB.1.raw
  modified_base (280)..(280): a, c, t, g, unknown or other
  misc_feature (280)..(280): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangctatgcactgggtcccgccaggctccgaggggaagggactgggaatatgtctcaggtattagaagtaatgacgaataacatatattatgacaaactctagtgaagggcagattcaccatctccagggacaattccaaagacacgctagtatcttacaaagtgggacaggcctaggagagctggaggacacgggctgtattagttacgtggtagggaggaagggacggtacggtaagtttcgggaaaccgttaggggtttcggtagggggaccgtaacggggg

SEQ ID NO: 268083 - DNA, 644 bp, Homo sapiens
  misc_feature: GYAE6OF02HFASE.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgcgcagcctctggattcaccttcagtatttatgctatgcactgggtccnccgaggcctccgagggaagggactggaatagtgtctcgaggtattagaagtatgacgaataacattaatattatgacaaactctagtaggaagggcaagtacttacaacctatcctaccgaagggaactaaacttaccgaaacgaaacacgtacttagtacttaccttacaaacgtcgggacacgtccgtagacgagtcgtacggaaggaaccgacggtacttagtactttacgtttacggtcgggtaggggaacggaaggggtaacggaacggggttaaaggtttacggggaaaccggtttaggggggtttacgggttaccggggggacccggtaacgggggg

SEQ ID NO: 268084 - DNA, 525 bp, Homo sapiens
  misc_feature: GYAE6OF02HURIU.28.57.F02.1.454.CMB.1.raw
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (447)..(447): a, c, t, g, unknown or other
  misc_feature (447)..(447): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtcccctgagactctcctgtgcagcctctggattccaccttcagtattttatgctatgcactgggtccgccaggcctccgaggggaagggactggaatatgtctcaggtattagaagtaatgacgaataacatataattatgacaaactctgtagaagggcagatcacatcncaggacattccaagacacgntntatctacaatggcagcctgagngctagacggacacggctgtattatacgtggtggagaggagacggtattcggaacgttggggtggtcgggacgtagggg

SEQ ID NO: 268085 - DNA, 557 bp, Homo sapiens
  misc_feature: GYAE6OF02GJBBA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggcctccgaggggaaggactggaatatgtctcaggtattagaagtaatgacgaataacatatattatgactaaactctagtagaagggcagtacttcaccatctaccgagggacaattaccaagaaccacgctgttactcttacaagtgggacagcctgacgagcgtggacgacgacggctagttatattacgtggtagggaggaggaggacggtaagttgggaacgttaggggttcggtagggggcgtaacggggg

SEQ ID NO: 268086 - DNA, 633 bp, Homo sapiens
  misc_feature: GYAE6OF02GD6DT.28.57.F02.1.454.CMB.1.raw
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactggtccgcaggctccgagggaaggactggaatatgtctcaggtattagaagtaatgcgaaataacatatattatgacaaactctgtgaagggcagattcaccatctcaggacaattccaagaaccacgctagtataccttanaaagtcgggacacgtccgtaggagtacgtccgtaggaacggaccgaacgggtaccttagggttaacttaagttttaaccgtaggggttacgggggaaaggtaacgggggaacgggttaaccgggggaaagttttacggggggaaacccggtttaaagggggggtttcggggttaacgggggggtacccgtaaaccggggggg

SEQ ID NO: 268087 - DNA, 583 bp, Homo sapiens
  misc_feature: GYAE6OF02I2ZIC.28.57.F02.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (498)..(498): a, c, t, g, unknown or other
  misc_feature (498)..(498): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtcccctgagactctcctgtgcagcctctggattcaccttcagtatttatgctatgcactgggtccncaggctccgagggaagggctggaatatgtctcgaggttattagaagtaatgacgaataacatatattangacaactctgtagaagggcaagacttcaccatcctaccgagggacctaacttaccgaaacgaacaaccggtacttgttactctttacgaaatcgggactaggccctaggaacgagcgtagacggacacggntagttattacttacgtggtaggggacgaggacggaggtaagttcgggtaacgttaggggtacgggttacggggaccgtaacgggg

SEQ ID NO: 268088 - DNA, 547 bp, Homo sapiens
  misc_feature: GYAE6OF02GWE2L.28.57.F02.1.454.CMB.1.raw
  modified_base (459)..(459): a, c, t, g, unknown or other
  misc_feature (459)..(459): n is a, c, g, or t
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggctccgagggaggactggaatatgtctcaggtattagaagtatgacgaataacatatattatgactaaactctgtagaagggcagtattacacatctcgaggactaattaccaagaacacgactagtattcttacaaagtgggacagcctagagagntagaggacacggctagtatattacgtggtaggaggaggagacggtaagttacgggaacgtaggggtttacggngggggacctacgggg

SEQ ID NO: 268089 - DNA, 585 bp, Homo sapiens
  misc_feature: GYAE6OF02GWNGD.28.57.F02.1.454.CMB.1.raw
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (505)..(505): a, c, t, g, unknown or other
  misc_feature (505)..(505): n is a, c, g, or t
  modified_base (520)..(520): a, c, t, g, unknown or other
  misc_feature (520)..(520): n is a, c, g, or t
  modified_base (570)..(570): a, c, t, g, unknown or other
  misc_feature (570)..(570): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccaggccgtgggggggtccctggagactctcctgtgcagcctctggattcaccttcagttatttatgctatgcactgggtccgcaggcctccgaggggaacggactaggaatatgtctcgaggtatagaagtaangacaataacatatattangacaaactctgtaggaacggcagacttcaacatcctaccgaagggtacaagttaccaaagaaccacggtactagttacttaccttacaaagtggactaacgcctaggacgagtcgtagaacggacacgggnttagtatagttacgngggttacggaggtaggaggacgtaaggttgggaacgttaggggttcgggngggtacggtacgggg

SEQ ID NO: 268090 - DNA, 591 bp, Homo sapiens
  misc_feature: GYAE6OF02H9M98.28.57.F02.1.454.CMB.1.raw
  modified_base (280)..(280): a, c, t, g, unknown or other
  misc_feature (280)..(280): n is a, c, g, or t
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctattttaaaggtgtccagtgtgaggtgcagctggtggagtctgggggaggctggtccagcctggggggtccctgagactctcctgtgcagcctctggattccaccttcagtatttangctatgctacgtcgggtccnccaggcctccgaggggaaggctggaatatgtctcgaggtattagaagtaatgacgtaaataacatatattatagctaaaactctagtgaagggtcaagacttcgaaccatctaccgaaggacctaattaccaagaacacgtctagtatccttacaaagtcgggacagtccgtagagacggactagggacggaacacgggcttagtaagttacttacgtgggtagggaggaaggtacggacggtaaggtttacgggaaacggttaggggttgggtcgggggacctaaggggg

SEQ ID NO: 268091 - DNA, 562 bp, Homo sapiens
  misc_feature: GYAE6OF02G5GMX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagtatttatgctatgcactgggtcccgccaggcctccgaggggaacgggactggaatatgtctcgaggttattagaagtaatgacgaaataacattataattatagacaaactctgtaggaagggcagtattacacactctccgagggacaattaccaagaaccacgctgtactcttacaagtggacagctagagagctggacgacgacggctagtattagttacgtggtagggaggaggaggacggtaagttcggtaacggtaggggttcggtacggggacgtacgggg

SEQ ID NO: 268092 - DNA, 670 bp, Homo sapiens
  misc_feature: GYAE6OF02GRASY.28.57.F02.1.454.CMB.1.raw
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagtatttatgctatgcacgtggggtcccnccagggcctccgaaggggaagggactggaatatgtctcaggtattagaagtatgacgaataacatatattatgactaaactctaggtaggaagggtcaaggtactttaccgaaccctacgtccctacccgaagggaacctaaacgtttacccgaaagaacccaaccggcgtttagttaacttacctttaacgaaaagtttcgggggacctaaggtcccgttagggaacggtacgtaccgttagggaacggaccgaaccgggtcttaggttacttagtttacgtgggttagggaaggtaagggtaggtaacgggtaagtttacggggaaacgtttgggggtttaggtacgggggaccgtaacgggggg

SEQ ID NO: 268093 - DNA, 543 bp, Homo sapiens
  misc_feature: GYAE6OF02FXW45.28.57.F02.1.454.CMB.1.raw
  modified_base (455)..(455): a, c, t, g, unknown or other
  misc_feature (455)..(455): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcccgtggggggtccctgagactctcctgtgcagcctctggattcaccttcagtatttatgctatgcactgggtccgccgaggcctccgaggggaacgggactgggaatagtgtctcaggttattagaagtaatgacgaataacatatattatgacaaactctagtagaaggggcagattcacctatctccagggacaattaccaagaacacgctgtatctacaatggcagcngagagctagacgacacgctagtatattacgtggtagggaggaggaggaggtaagttagggaacgttagggtggtaggggccgtacggg

SEQ ID NO: 268094 - DNA, 631 bp, Homo sapiens
  misc_feature: GYAE6OF02G8APD.28.57.F02.1.454.CMB.1.raw
  modified_base (340)..(340): a, c, t, g, unknown or other
  misc_feature (340)..(340): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattcaccttcagtatttatgcttatgcactgggtacccgccgagggcctccgaggggaacgggactagggaatagtgtcncaagggttattaaggaaagtaatgaccgaaataacagttaataattaanagtactaaactctaggtagaagggctagattacaccactctaccgaagggaacaacgttaccaaagaacacgctagtactacttacgaaatcgggactacggacctaggaagagcgtggaaggaccgaacgggcttagtacgttaatttaccggtgggttacgggaaggtagggaacggtacggtaacgtttaggggaaaccggttaggggttacgggtacgggggtacccggtaacggggg

SEQ ID NO: 268095 - DNA, 566 bp, Homo sapiens
  misc_feature: GYAE6OF02HS0H9.28.57.F02.1.454.CMB.1.raw
  modified_base (551)..(551): a, c, t, g, unknown or other
  misc_feature (551)..(551): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtcccctggagactctcctgtgcagcctctggattcaccttcagtatttatgctatgcactgggtccgccaggctccgagggaagggactggaatgtgtctacgaggtattaggaagtaatgacgaataacataattattatagactaaacttctggtagaagggcagattccgaactatcctaccaggggaacaacgttacaaacgaacacgtctagtacttcttacaaatcgggactacgactgagagctggaggacacggctagtatagttacgtggtacgggagaggagaggtaagtgggtaattaggggttggngggtaccgtacgggg

SEQ ID NO: 268096 - DNA, 531 bp, Homo sapiens
  misc_feature: GYAE6OF02H90BN.28.57.F02.1.454.CMB.1.raw
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (367)..(368): a, c, t, g, unknown or other
  misc_feature (367)..(368): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccctgagactctcctgtgcagcctctggattcaccttcagtatttatgctatgcactgggtccnccaggctccgaggggaagggctggaatatgtcncaggtattagaagtaatgacgaataacatatattanncaaatctgtgaagggcagattcaccatcncaggacaacttaccaagaacacgctgtatcttanaaatggcagcctgagagctagagacacggctgtatattacgtggtaggagaggagacggtaagttcggaacgttaggggttggtacggggactaacgggg

SEQ ID NO: 268097 - DNA, 561 bp, Homo sapiens
  misc_feature: GYAE6OF02FRINM.28.57.F02.1.454.CMB.1.raw
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtcccgccgaggcctccgaggggaagggactgggaatagtgtctcgaggtattagaagtaatgacgaataacatatattangactaaactctgtgaagggcagattcacatcncgaggacaattaccaagaacacgctgtatcttacaaatgggacagcctgagagctgacggacgacggtctagttatattacgtgggtacgggaggtagggacggagggtaagttacgggaacggttaggggttaggtacggggacggtaacgggg

SEQ ID NO: 268098 - DNA, 537 bp, Homo sapiens
  misc_feature: GYAE6OF02JB1OQ.28.57.F02.1.454.CMB.1.raw
  modified_base (328)..(328): a, c, t, g, unknown or other
  misc_feature (328)..(328): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggagcttggtccagcctggggggtccctgagactctcctgtgcagcctctggattcaccttcagtatttatgctatgcactgggtccgccaggctccgagggaagggactggaatatgtcncaggtattagaagtaatgacgaataacatatattatgactaaactctgtagaagggcagattcaccatctccagggacaagttccaacgaacacgtctagtattcttacaaagtggacagcctgagagctgaggacgacgcgttgtattattacgtgtagggagaggagacggaattgggtaacgttagggttggtaggggcgtacggg

SEQ ID NO: 268099 - DNA, 554 bp, Homo sapiens
  misc_feature: GYAE6OF02JXLM6.28.57.F02.1.454.CMB.1.raw
  modified_base (281)..(281): a, c, t, g, unknown or other
  misc_feature (281)..(281): n is a, c, g, or t
  modified_base (326)..(326): a, c, t, g, unknown or other
  misc_feature (326)..(326): n is a, c, g, or t
  modified_base (473)..(473): a, c, t, g, unknown or other
  misc_feature (473)..(473): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtcgtgggggaggcttggtccagccgtggggggtccctgagactctcctgtgcagcctctggattcaccttcagttatttangctatgcagtcgggtccgccaggctccgagggaaggctaggaatntgtctcgagtattagaagtagtgacgaataacatatattatgactaactctgtaggaaggcagtatcacagtcacgaaggacaacttacaagacacgctagtactactacgaagtggacacgtcgagagagcgtagacgacgacgtntagtattagtacgtgggtaggagtacggtagtacgggtaagttcgggtaacgttaggggtacggtggggaccgtaacgggg

SEQ ID NO: 268100 - DNA, 591 bp, Homo sapiens
  misc_feature: GYAE6OF02GI5KK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtcccgccgaggcctccgaggggaacgggactaggaatagtgtctcgaggttattagaagtaatgacgaataacataatattatgactaaactctagtagaagggcagtattaccacctatccgtaccgaagggaactaacgttaccaaagaaccacgtactagttactcttacgaaagtcgggacacgcctagagagcgtaggacggacgacggtctagtattagttacgtggtagggagaggagacggtaagttcgggaacggttaggggttcgggtcggggaccgtaacggggg

SEQ ID NO: 268101 - DNA, 576 bp, Homo sapiens
  misc_feature: GYAE6OF02GU7DZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagccgtgggggggtccctggagactctcctgtgcagcctctggattcaccttcagttatttatgctatgcacgtgggtcccgccgaggcctccgaggggaagggactaggaatatgtctcgaggtattagaagtatgacgaataacatatattatgacaactctgtggaagggcagtatcacctatcctcgaggactaacttaccgaaagaacacgctagttactcttacaaagtcgggacacggcctagagagcgtagaaggaccgacggcttagtattacgttacgtggtagggaggagggagacggtaagttacgggaaggttaggggttcggtacgggggacgtacgggg

SEQ ID NO: 268102 - DNA, 531 bp, Homo sapiens
  misc_feature: GYAE6OF02G33Y8.28.57.F02.1.454.CMB.1.raw
  modified_base (176)..(176): a, c, t, g, unknown or other
  misc_feature (176)..(176): n is a, c, g, or t
  modified_base (213)..(213): a, c, t, g, unknown or other
  misc_feature (213)..(213): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
  modified_base (456)..(456): a, c, t, g, unknown or other
  misc_feature (456)..(456): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
tcagagtacgctatcacgaccggtgctcgatttagctcgatatagttgggtcgtgggagaggagcccccgccctcgggtttcccgaggtgttctcatttggtgatcagcactgcacacagaagagtcatgacggagtttgggctgagctgggtttccttgttgctatttttaaagngtccagtgtgagtgcagctggtggagtctgggggagnttggtccagctggggggtccctgagactctctgtgcagcctctggaattcacttcagtatttatgcctatgcatgggtccaccaggtctccagggaagggacttggaaatatcgtctnaggtaattagaaagtaatccnggaaataaacntaatagtaatcgacaaaactgtgtgaaacgggcagattcacagtctaccagggacaattccaagaaccaagtcngtatctacgaaatacgggnaagcctagagagtactgaggactacgatgtanatacctgtagngacgatcgaagtgacctagggtntgggcaggg

SEQ ID NO: 268103 - DNA, 572 bp, Homo sapiens
  misc_feature: GYAE6OF02GGMFT.28.57.F02.1.454.CMB.1.raw
  modified_base (434)..(434): a, c, t, g, unknown or other
  misc_feature (434)..(434): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaggactggaatatgtctcaggtattagaagtaatgcgaataacattaatattatgacaaactctgtgaagggcagattcacatctccagggacaacttaccaagaacacgtctagtatacttanaaatgggacagacctggagagtcgtgtaaggacgaacggcttagtataagttacgtcggtagggaggtaagggacggacggtaacggttagggtaaaccggttaggggtttacggttacgggggaccggtaacggggg

SEQ ID NO: 268104 - DNA, 613 bp, Homo sapiens
  misc_feature: GYAE6OF02H22VJ.28.57.F02.1.454.CMB.1.raw
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggagcttggtccagccgtggggggtccctgagactctcctgtgcagcctctggattcaccttcagtatttatgctatgcactcgggtccgccaggctccgaggggaagggactgggaattatgtctctagggttattaaggaagtaatgacgaaataactatattattangacctaaatctaggtagaagggcagtattcacctatctaccgagggactaaacttccaaagaaccacggtcttagtaacttcttaacaaagtcgggacaggcctaggagacgcgtaggacggaccgacgggtcttaggttactacgttttacgtgggtagggaaggtaagggacggacgggttaagtttacggggaaacgtttagggggttcggtagggggacccgtaaggggg

SEQ ID NO: 268105 - DNA, 598 bp, Homo sapiens
  misc_feature: GYAE6OF02G1COR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaaggactggaatagtgtctcaggtattagaagtatgcgaataacatatattatgacaaaactctagtaggaagggctagtattaccactactctaccggaaggaactaacttaaccgaacgaaaccacgtacttagttacttaccgttaactaaggtcggactacggaccctaggtacgacgtcgtagaacggacgaaccgtctagttacttattacgtgggtacggaggaggaggtacggtaagttacgggtaaggttaggggtacggttacggggacgtaacgggg

SEQ ID NO: 268106 - DNA, 631 bp, Homo sapiens
  misc_feature: GYAE6OF02J189Z.28.57.F02.1.454.CMB.1.raw
  modified_base (295)..(295): a, c, t, g, unknown or other
  misc_feature (295)..(295): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggagcttggtccagcctggggggtccctgagactctcctgtgcagcctctggattcaccttcagtatttatgctatgcactgggtccnccaggcctccgagggaagggctgggaatatgtctcgaggtattagaagtaatgacgaataacattatattatgacaaactctagtagaagggcagtatacacctatctaccgagggtaactaacttaccgaaagtaaccgacgtacttacgttaagttaccttacgaaacgttcgggactacggtacccgtagaacgtacgtccgtaggaacggaccgaacggtacgttacgttagttaacgtttaccggtaagggtacgggtaaggaagggtacggtacggtaacggttacgggtaaccgttaaggggtttcgggtacggggccggtaacggggg

SEQ ID NO: 268107 - DNA, 593 bp, Homo sapiens
  misc_feature: GYAE6OF02JCK9F.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgcaggcctccgaggggaagggactggaatagtgtctcaggtattagaacgtaatgacgtaaataacatatattatgacaaactctgagagggcagtatcaccatctcagggtacataccaacgaacacgctgtactcttacaatgggacagacctagagcgtacgtgaacggtacgacggacttaggttattaacgttaccggttagggtacgggaaggtacgggtaaggtacgggttaagtttacggggtaaaccggtttaggggtttacgggtagggggtacccggtaacggggg

SEQ ID NO: 268108 - DNA, 619 bp, Homo sapiens
  misc_feature: GYAE6OF02IV7SW.28.57.F02.1.454.CMB.1.raw
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggtcttggtccaggccgtggggggtccctgagactctcctgtgcagcctctggattccaccttcagttatttatgctatgcacgtcgggtccgccgaggcctccgaaggggaacgggctaggaatagtgtactcgaggttattaagaagtaatgacgaaataacatatattatgactaaactcgtaggtagaagggcaagtacttaccacctattcctaccgaagggaactaacgttaccaaagaaccacgtactagttaactccttaanaaacgtcgggacacgacctagagacgtcgtaggacggacacggtcttagtattagttacgtgggtagggaacggaggtacggacggttaagttacgggaacggttaggggttcgggtacggggaccgtaacggggg

SEQ ID NO: 268109 - DNA, 538 bp, Homo sapiens
  misc_feature: GYAE6OF02FG5NG.28.57.F02.1.454.CMB.1.raw
  modified_base (366)..(366): a, c, t, g, unknown or other
  misc_feature (366)..(366): n is a, c, g, or t
  modified_base (397)..(397): a, c, t, g, unknown or other
  misc_feature (397)..(397): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgctatttttaaaggtgtccagtgtgaggtgcagctggtggagtctgggggaggcttggtccagccgtggggggtccctgagactctcctgtgcagcctctggattcaccttcagtattatgctatgcactggtccgccaggctccagggaaggactggaatatgtctcaggttattagaagtaatgacgaataacattatattangacaaactctgtgaagggcagattcacatcnccagggacaattccaagacacgctagtatcttacaatgggacagcctagagagctagagacgacggctagttactattacgtggtagggagagggagacggtaagttgggaacgttaggggtggtaggggccgtaacgggg

SEQ ID NO: 268110 - DNA, 551 bp, Homo sapiens
  misc_feature: GYAE6OF02G7YJB.28.57.F02.1.454.CMB.1.raw
  modified_base (505)..(505): a, c, t, g, unknown or other
  misc_feature (505)..(505): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcacctttcagttatttatgctatgcactgggtccgccaggctccgaggggaaggactggaatatgtctgaggtattagaagtatgacgaataacatatattatgactaaactctagtaggaagggcagattccacctatctccagggacaacttaccaagaacacgctgtacttcttacaagtgggacagcctgagagcgtggagacgacggctagtatattacgtggtagggagagggngtacggtagttggaacggttaggggtcggtggggtaccgtacgggg

SEQ ID NO: 268111 - DNA, 584 bp, Homo sapiens
  misc_feature: GYAE6OF02G9PNS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggcctccgaggggaagggactggaatatgtctcaggttattagaagtaatgacgaataacatatattatgactaaactctgtagaagggcagtattcacctatcctccgagggacaattccgaagacacgctgtatcttacaagtgggcacgtcctaggacgagtcgtaggaacggaccgacggtcttagtattacgttacgtgggtagggaaggtagggacggacgggtaagttacgggtaaccggttaggggtttacgggtcgggggacccgtaacggggg

SEQ ID NO: 268112 - DNA, 556 bp, Homo sapiens
  misc_feature: GYAE6OF02HQ753.28.57.F02.1.454.CMB.1.raw
  modified_base (392)..(392): a, c, t, g, unknown or other
  misc_feature (392)..(392): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccagggaagggctggaatatgtctcaggtatagaagtatgacgaataacatatattatgcaaactctgtgaagggcagattcacatcncaggacatccaagaacacgctagtattctacaaagtgggacaggcctaggagtacgcgtagacgggacaacgggctggtaattacgttacgtggtcgggaagaagggagtacgggtaagtttcgggaaacgttagggggttagtcgggggacccgtaagggggg

SEQ ID NO: 268113 - DNA, 570 bp, Homo sapiens
  misc_feature: GYAE6OF02HNTKW.28.57.F02.1.454.CMB.1.raw
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcactgggtccgccaggctccgaggggaaggactggaatatgtctcgaggtattagaagtaatgacgaataacatattatatgacaaactntagtgaagggcagattacacctatctaccagggaactaacttaccgaaagaaccacgtacttagtacttactacaaagtcgggacagtccagagagtacgtagaggacgacggtgtagttatagttacgtggtagggagaggacggacggtaagttaggtaagttaggggttaggtagggcggtaacgggg

SEQ ID NO: 268114 - DNA, 568 bp, Homo sapiens
  misc_feature: GYAE6OF02FYN7F.28.57.F02.1.454.CMB.1.raw
  modified_base (479)..(479): a, c, t, g, unknown or other
  misc_feature (479)..(479): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcttggtccaggccgtgggggggtccctgagactctcctgtgcagcctctggattcaccttcagtatttatgctatgcactgggtccgccaggctccgaggggaggactggaatatgtctcaggtattagaagtaatgacgaataacatatattatgactaaactctgtaggaagggcagattacaccatcctcagggactaacgttccaagaacacgctgtactcttacaaagtcgggacacgactgagagcgtagaacgganaacggctagtatagttacgtggtagggagagggaggtacgggtaagtttacgggaacggttaggggttggtacgggggcgtaacggggg

SEQ ID NO: 268115 - DNA, 685 bp, Homo sapiens
  misc_feature: GYAE6OF02JXH5G.28.57.F02.1.454.CMB.1.raw
tcagagtacgctatcacgaccggtgctcgatttagctcgatatagttgggttcgtgggtagacggaggcccccgccctgggtttcccaggtgttcctcactttcggtgatcagcactggccacgaccagaagagtccatgacggagtttgggctcgagctgggttttccgttgttgcgtatttttaaaggtgtccagtcgtgaggtgcagctggtacggagtcgtgggggagcttggtccgagtccgtggggggtccctgagactcgtcctgtgcacgcctcaggaccttcaccttcagtatttatgacgtatgcacgtcggtccgcgtaggtcctccgagggtaacggctggaactatacgtctacgtaacggtattaaggaacgttaactgacgaaactacattagtattagtgacaaacgtcgtaggtaggaggtacagttattacacctatcctaccgaaggtaacctaattaccaagtaaccgagtcgtacgtacttccgtactaaaggtcgggtaccacggtaccgtaggaacgtacgtaccgttaggaacggtacccggaacggttccgtaggttaccttaacgttcccggtacgggttacggaaggtcgggtaaccggtaccggtaacgttaccggggacgtttaggggttagggtacccggggaccggttaagggg

SEQ ID NO: 268116 - DNA, 590 bp, Homo sapiens
  misc_feature: GYAE6OF02G5ZQ2.28.57.F02.1.454.CMB.1.raw
  modified_base (426)..(426): a, c, t, g, unknown or other
  misc_feature (426)..(426): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgagggaaggactggaatatgtctcgaggttattaaggaagtaatgacgaataacatatattatgacaaactctagtagaagggcagacttcaccatctaccgaggacaattaccgaanaacacgtctagtaactcttacaaatcgggacacggcctggaagacgcgtggaacggacacggtcgtagtattagtttacgtgggttacggggagagggtaggacggtaaaggtttgggaaacgggtttagggggtttcgggtacgggggacccggtaacggggg

SEQ ID NO: 268117 - DNA, 808 bp, Homo sapiens
  misc_feature: GYAE6OF02IW50P.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcgttggtccagccgtggggggtccctgagactctcctgtgcagcctcgtggattccaccttcagttatttatgctatcgcacgtgggtccnccgaggcctccgaaggggaacggtacctagggaattacgtgtcctacgaagggttattaaggaaacgttaagtaggacgtaaataacgattaataattatagactaaactcgttaggtaggaaacgggctaaggtacttaccaaccgtactttacccgtaccggaaacgggtaacctaaacgttacccgaaaaacggtaaacctaccggtacctttagtttaaaccttacccgtttaacgtaaaacggtccggggtaaccgtaccggtaacccgttaaggggtaaacggtaaccgttaccggttaacgggaacgggtaaaccccggtaacgggggttacttaacgggtttaagtttaaccgttttaacggggttaacgggtaagggggtaaacgggtaaaccgggtaaggggttaacccggggttaaaggtttaaccgggggtaaaccggtttaaggggggtttaccggggtttaccggggggggacccgttaaaccggggggg

SEQ ID NO: 268118 - DNA, 544 bp, Homo sapiens
  misc_feature: GYAE6OF02FN0FD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtcccgccaggctccgaggggaagggactgggaatatgtctctaggtattagaagtaatgacgaaataacattatattatgacaaactctgtggaagggcagattcaccatctccgaggacaattccaaagaacacgctagtactcttacaaagtcgggacagcctgaagagctagacggacacggctaggtatattacgtggtagggagaggagacggtaatggaacgttagggtggtcgggcgacgggg

SEQ ID NO: 268119 - DNA, 732 bp, Homo sapiens
  misc_feature: GYAE6OF02I3YCQ.28.57.F02.1.454.CMB.1.raw
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctattttttaaaggtgtccagtgtgaggtgcagctgggtggagtcgtgggggaggcttggtccagccgtgggggggtccctgagactctcctgtgcagcctctggattcaccctttcagtattttatgctatgcacgtgggtcccgccacggctccgaggggaacgggactggaatatgtctcaggtattagaagtatgacgaataanatatattatgacaaactctagtagaacgggcagtacttacaccattcctaccgagggtaactaacttaccgaaacgaaccgacgtacgttagttaacttaccgttacaaaagtcgggactaacgcccgttaggaacggtacgtccgttaggaacggggtaccgaacccgggttagttacggttaacgttttaagttttaacccggttaggggtttagggggaaaaggggtaacggggtaacgggggtaaaccgggggtttaaacggttttaacggggggtttaaaaaccccgggggttttagggggggggtttttaaccggggtttaccgggggggggacccgggttaaaaccggggggggg

SEQ ID NO: 268120 - DNA, 594 bp, Homo sapiens
  misc_feature: GYAE6OF02I5WGX.28.57.F02.1.454.CMB.1.raw
  modified_base (279)..(279): a, c, t, g, unknown or other
  misc_feature (279)..(279): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttangctatgcactgggtccgcaggcctccgagggaagggctggaatatgtctacaggtattagaagtaatgacgaataacatatattatgacaaactctgtagaagggcagtattaccaccatcctaccgagggaactaacttaccaaagaacacgcttagttacttacctttacaaaagttcgggactacgtacccgttagaacgtagcgtagacggaccgacgggtctagtacttattaacgtggtacgggaaggaggacggtacggtaagttacgggtaacggttaggggttaggtcggggtaccgtaacggggg

SEQ ID NO: 268121 - DNA, 578 bp, Homo sapiens
  misc_feature: GYAE6OF02GOIP5.28.57.F02.1.454.CMB.1.raw
  modified_base (310)..(310): a, c, t, g, unknown or other
  misc_feature (310)..(310): n is a, c, g, or t
  modified_base (435)..(435): a, c, t, g, unknown or other
  misc_feature (435)..(435): n is a, c, g, or t
tcagagtacgctatcacgaccggtgctcgatttagctcgatataggttggggtctgggagaggagcccccgccctggggtttccccaggtggttctcatttcggtgatcagcactgcacacagaagagtcatgacggagtttgggctgagctgggttttcctgttgctatttttaaaggtgtccagtgtgaggtgcaggctggtggagtctgggggaggcttgggtccagcctggggggtccctgagactctcctgtgcagcctctggattcgaaccttcagttatttatcgctatgctacgtgggtccnccaggcctccgagggaagggactggaatagtgtctcaggtatagaagtaatgacgaataacatatattagtgactaaactctagtgagggcagattcacatctcgaggacaataccaagacacgntagtatcttacaatggcagcctaggagagtcgtaggaggaccgacggtctaggtatacgttagtgggtagggaggagggtaaggtacgggaagtttcggggaaaccgtttagggggttcggtacgggggtaccgtaacggggg

SEQ ID NO: 268122 - DNA, 568 bp, Homo sapiens
  misc_feature: GYAE6OF02GAUQ1.28.57.F02.1.454.CMB.1.raw
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (442)..(442): a, c, t, g, unknown or other
  misc_feature (442)..(442): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgaggggaagggactggaatatgtctcgaggttattaagaagtaatgacgaataacatatattatgacaaactctgtagaaggcagattcaccatccacgaggactaacttccaaanaacacgntagtatccttanaaagtcgggacagcctaggagagctaggacgacacggtctagtattagttacgtggtagggaggacggtaggaccggtaagtttcgggaaacggtttaggggttggtcggggacccgtaacggggg

SEQ ID NO: 268123 - DNA, 802 bp, Homo sapiens
  misc_feature: GYAE6OF02IS6DB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtgggttttccttgttgctattttaaaggtgtcagtgtgaggtgcagctggtggagtcgtgggggaggcttggtccagccgtggggggtccctgagactctcctgtgcagcctctggtattccaccttcagttatttatgctatgcacgtcggggtcccgccgaggcctacccggaggggaacggggtacgtaggggaaacttgttacggtccgttacgtaagggttaagttaaggtaaaggttaagttacgaacggtaaaactaaaccgtaattaaatttaaatttaagttacgaacttaaaaccgtcgttacggttagggaacggggtacctaaggtaacctttacccaaacccgtaacttacccgtaacccgggtaacgggtaaacctaaaccgtttaacccgaaacggtaaacccgtacggtacctttacgttaaacgttaccgtttaaacctaaaggtcgggtacgtaaccggtacccgttaggaacggtacggtacgtacgggaaacgggtaccgtaaccgggtcgtttagttagttaacgtttaaggttcgggtaacgggggtaagggagggtaaccgggtacgggttaaacggtttacggggtaaaccggttgggggtttagggggtccgggaccggggtaacggggg

SEQ ID NO: 268124 - DNA, 521 bp, Homo sapiens
  misc_feature: GYAE6OF02F23HL.28.57.F02.1.454.CMB.1.raw
  modified_base (445)..(445): a, c, t, g, unknown or other
  misc_feature (445)..(445): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaaggactggaatatgtctcaggtattagaagtaatgcgaataacatatattatgacaaactctgtgaagggcagattcaccatctcaggacaattccaagaacacgctgtatcttacaaatgggcagcctgagngcgtgaggacacggctgtatattacgtgtagggagaggagcggaattggaacgttagggtggtgggaccgtagggg

SEQ ID NO: 268125 - DNA, 703 bp, Homo sapiens
  misc_feature: GYAE6OF02FXFXG.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaaggactggaatatgtctcaggtattagaagtatgacgaataacatatattatgacaaatctagtagaagggcagacttacacctatctcgagggactaacttaccaaagaacacgtactagttaactccttaacaaagtcggggactaacgggacccttaggaacggtacggtaccgtagggtaaacgggaaccgttaaccggggaccgtttacgggttaacttaacggttttaacccggttaggggttaaccggggggttaaagggtaacggggggtaacggttaaccgggggttaaaacgttttaacggggggttaaaaacccgggttttaggggggggtttttacgggttaccgggggggggtaccccgttaaaaccgggggggggg

SEQ ID NO: 268126 - DNA, 752 bp, Homo sapiens
  misc_feature: GYAE6OF02HKGW5.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcgttggtccaggccgtggggggtccctgagactctcctgtgcagcctctggacttccaccttcagttatttatgtctatgctacgtcgggtcccgccgacgggcctaccggaaggggaacgggacgtagggaaattagtcggtcctacgtaaggttaattaaggtaaagtaagtacgacgtaaataactaattaattaattaatacgaacctaaaacttcgtaggtaggaaacgggtctaaggtacttacccaacctaattcccgtaaccggaacggaaactaaacgttacccgaaaaggtaaccaccggtacttacgtaactttccgttaacgaaacggtcggggacctaacggtacccgtaggaacggacggtacgtaacgggaacgggtaaccgtaccgggtacgtttaggttaactttaacggttttaaccggtggggtaaggggaacggtaaggggtaacgggtaacggtaacgggtttacggggtaaacggtttgggggggttacgggtacggggggtacccggtaacggggg

SEQ ID NO: 268127 - DNA, 548 bp, Homo sapiens
  misc_feature: GYAE6OF02HLRYL.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaagggactggaatatgtctcaggtattagaagtaatgacgaataacatatattatgacaaactctgtagaagggcagattcaccatctcaggacaattccaaagaacacgctagtatcttacaaagtgggacaggcctaggagagcgtagaggacacggctgtatacgttacgtggtgggagaggacgaggtaagttgggaaacgttaggggttcggtacggggtaccgtaacgggg

SEQ ID NO: 268128 - DNA, 697 bp, Homo sapiens
  misc_feature: GYAE6OF02I4K3I.28.57.F02.1.454.CMB.1.raw
  modified_base (589)..(589): a, c, t, g, unknown or other
  misc_feature (589)..(589): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccaggccgtcgggggggtccctggacgtactcctccgttgtcgccacgccttcgtggtactttccgtaccctttacgtagtttaattttatcgtacttatcgctacggttcgggtcccgccgaggccgtaccggaaggggaacggggactagggaaattatggtacctacgtaaggttattaaggaaagtaatgaacgaaataaacattaatattaagtagactaaactctaggtaggaagggcagtacttaccgaacctatccgtaccgaaggtaacctaaacttaccgaaaacgaacacggtacttcgttaacttccttaacgaaagtgggccaggcctagacgtagcgtaggaaggacctacggnttacgtacgttatttacggtagggttacggggaaaggcggtaaggaccggttaaaggttacgggtaaacggtttgggggtttacgggacgggggtaccgtaacggggg

SEQ ID NO: 268129 - DNA, 536 bp, Homo sapiens
  misc_feature: GYAE6OF02G20XO.28.57.F02.1.454.CMB.1.raw
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (411)..(411): a, c, t, g, unknown or other
  misc_feature (411)..(411): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtcggtttcgtgtaggcgtactttaaagtagtcagtgtgaggtgcagctggtggagtctgggggaggcttggtccagcctggggggtccctgagactctcctgtgcagcctctggattcaccttcagtatttatgctatgcacgtgggtccncgaggctccgagggaaggactggaatntgtctcaggtattagagtaatgcgaatacgatatatatgacaatcagtagaggcagtattcacatctccgaggtacattcaagacncgctagtatctacaagtcggcagtcctgacgagtcgtgaaggcctaagccgtagtatagttaacgtgggtacggagtaggacgaggtaagttcggaacgttaggggttcggtagggacctagggg

SEQ ID NO: 268130 - DNA, 666 bp, Homo sapiens
  misc_feature: GYAE6OF02G0DBT.28.57.F02.1.454.CMB.1.raw
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggacgttgggtcccagcccgtggggggtcccctgagactctcctgtgcagcctctggattcaccttcagttatttatgcttatcgcacgtcggggtcccgccaggcctccgaggggaaggacgtaggaatagtgtctagaggtattagaagtaatgacgaataacatatattanagactaaactctgtaggaaggcagtacttacaacctatcctaccgaacgggtaactaaacttacccgaaaacgaaccaaccgtacttacggttaacttacctttaacaaacggttcggggactaacggcctaggaacgaggtcgtaggaacgggacgtacgggtcttaggttacttagtttaccggttggttaacggggaaggtaagggaacggtacgggtaacgtttaggggaaaccggtttagggggtttagggtacgggggacccgtaacgggggg

SEQ ID NO: 268131 - DNA, 556 bp, Homo sapiens
  misc_feature: GYAE6OF02FXW48.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtcccgccaggcctccaggggaaggactgggaatatgtctcgaggtattaagaagtaatgacgaataacatatattatgacaaactctagtgaagggcagattcaccatctccgaggacaattccaaagacacgctagtatcttacaagtgggacacggctagagagctaggacgacgacgggtctagttatattacgtggtagggagaggtaggacggtaagttacggaacggttaggggtgggtacggggaccgtacgggg

SEQ ID NO: 268132 - DNA, 616 bp, Homo sapiens
  misc_feature: GYAE6OF02I06QE.28.57.F02.1.454.CMB.1.raw
  modified_base (400)..(400): a, c, t, g, unknown or other
  misc_feature (400)..(400): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagcctgggggggtccctgagactctccgtgtgcagcctctggacttcaccttcagttattatgctatgcacgtgggtccgccaggctccgagggaagggtactggaatatgtcttcgaggtattaagaagtaatgacgaataactatatattatgacaaacttgtagtaggaacgggnaagtacttacaccaattcctccgaaggaacaaattccaaagaccacgacttagtactacttacgaaagtcgggactacggcctaggacgtagcttagggaacgtacgtaacggcgttagttaccgtatttaccggtaggtgggaaaggtacgggacggtaggtaacggttaggtaaccggttagggggtttgggttaccggggaccggtaacgggg

SEQ ID NO: 268133 - DNA, 583 bp, Homo sapiens
  misc_feature: GYAE6OF02IAFO4.28.57.F02.1.454.CMB.1.raw
  modified_base (174)..(174): a, c, t, g, unknown or other
  misc_feature (174)..(174): n is a, c, g, or t
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaaggngtccagtgtgaggtgcagctggtggagtctgggggaggcttggtccagccgtggggggtccctgagactctcctgtgcagcctntggattcacttcagtatttangctatgcatgggtccgccaggctcccgagggaagggactggaatatgtctcaggtattaggaataagtgacgaaataacgataataattanagcaaaactctagaggtaagggcagattcaccatctacgagggaccaattacaagaacacgctagtatcttacaaatggacacgtcctagacgagacgttaggacggtacgaacggctagttataattacggtggtacgggtaggagggtaacggacgggtaagttacgggtaaacggttaggggtttagggtcgggggaccggtaacggggg

SEQ ID NO: 268134 - DNA, 568 bp, Homo sapiens
  misc_feature: GYAE6OF02GPS4H.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagcctggggggtccctgagactctcctgtgcagcctctggattcaccttcagtatttatgctatgcacgtgggtcccgccgaggcctccgaggggaagggactggaatatgtctctaggtattagaagtatgacgaataacatatattatgacaaactctgtagaagggcagattcacctatctccgagggactaacttccgaaagacacgactagttattaccttacaaagtcgggacagcctggaagagacgtaaggacacggcttagtattacttagtaggtgggagacgggaggacggtaagttacgggaacgttaggggttggtaggggccgagggtaccgg

SEQ ID NO: 268135 - DNA, 579 bp, Homo sapiens
  misc_feature: GYAE6OF02IRJMD.28.57.F02.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcaccttcagtatttangcttatgcacgtcgggtccncaggctccgagggaaggctggaatatgtctcgaggtataggaataangacgaaatacatatattangactaactctagtagaaggcagtattcgaaccatccaccgaggtaacaacttccaaagtacgacgtnttacgtatcctaacgaagtcgggacagtcctagagacgcgtagacgacgacggtctagtacttaagttacgtgggtacgggtagacgggaagtacggtaaagttcgggaaacgtttaggggttcggtacggggtacccgaagggg

SEQ ID NO: 268136 - DNA, 655 bp, Homo sapiens
  misc_feature: GYAE6OF02IDQIX.28.57.F02.1.454.CMB.1.raw
  modified_base (282)..(282): a, c, t, g, unknown or other
  misc_feature (282)..(282): n is a, c, g, or t
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtgcagcctctggattcaccttcagtatttangctatgcacgtcgggtccgccaggcctccgaagggaaggcgtaggaatagtgtctacgaggttaattagaaagtatgaacgaaataacataatattanagactaaactctaggtagaagggcaagtacttaccgaacctacgtcctaccgaaggtaacctaaacttaacccgaaagaaaccgaccgttaactgtaacttacttaacaaaggtcgggacacggtaccgtagagacgacgtaggaacggaccgacggtacttagttaacttaacgttacgtaaggggtacgggtaaggtaagggacggtaacggtaacggtttacgggtaaaacgggtttgggggttaacgggtcggggaacccggtaacggggg

SEQ ID NO: 268137 - DNA, 724 bp, Homo sapiens
  misc_feature: GYAE6OF02IYQUB.28.57.F02.1.454.CMB.1.raw
  modified_base (293)..(293): a, c, t, g, unknown or other
  misc_feature (293)..(293): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggaggcgttggtccagccggtggggggtccctggacgactctccgtgtcgcagcctgtggacttcaccttcagttatttangcttatgcacgtcgggtcccgcgaggcctaccggaagggaacggtacgtaggaacttagtgtcctacgtaggttagttaagaaagttatgaacgaaataacattaattattagtctaaactaaactcgtaggtaggaacgggatacggtacttaccgaacctagttcctaccggaaagggaaacctaaacttaacccgaaacgaaacctaccgtagttaacggttacttaccgttaacgtaaaggtccgggtacgtaaacgtccgtaggaacgtaacgtcgttaacggaaccgggtaccgacgggttacgttacgttagtttaaaccgttggttaacggggtagggaaagggtaacgggtacgggtaaggttaaacggtttaaggggtaacggtttaggggggttacgggtacggggacggtaaccggggg

SEQ ID NO: 268138 - DNA, 574 bp, Homo sapiens
  misc_feature: GYAE6OF02F4RZ7.28.57.F02.1.454.CMB.1.raw
  modified_base (456)..(456): a, c, t, g, unknown or other
  misc_feature (456)..(456): n is a, c, g, or t
  modified_base (495)..(495): a, c, t, g, unknown or other
  misc_feature (495)..(495): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatgcacgtcgggtccgccgaggcctccgaggggaacgggactggaatatgtctcaggtattagaagtatgacgaataacataatattatgactaaactcgtagtagaagggcagtacttacacctatctcgaggacaacgtacaaacgacacgtctagttactccttanaagtgggcagtcctagagacgtctaggacgacgacggtnttagtatacgttacgtgggtagggaggaggaggaggtaagttcgggaacgttggggttacgggtcggggaccgacgggg

SEQ ID NO: 268139 - DNA, 656 bp, Homo sapiens
  misc_feature: GYAE6OF02HMNUT.28.57.F02.1.454.CMB.1.raw
  modified_base (262)..(262): a, c, t, g, unknown or other
  misc_feature (262)..(262): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttgggtccagccgtggggggtccctgagactctcctgtgcagcctcnggattcaccttcagttatttangctatgcacgtgggtcccncaggctccgaggggaaggctaggaatagtgtctacgtaaggtattaagaagtaatgacgaaataacattatattaangactaaactntagtaggaagggctagtacttacgaacctagtcctacgtaaggaactaaacttaccgaaacgaaaccacggtacttagttaacttacttaacgaaagtcgggacacgtaccgtgtaacgagtcgtaggaacggaccaacgggtacgttacgtaagtttaacgtttacggtaggttacggggaaggaagggtaacggtacgggttaaaggtttaacggggtaaaccggttgggggtttaacggtacgggggggaccgtaaccggggg

SEQ ID NO: 268140 - DNA, 728 bp, Homo sapiens
  misc_feature: GYAE6OF02H25RJ.28.57.F02.1.454.CMB.1.raw
  modified_base (258)..(258): a, c, t, g, unknown or other
  misc_feature (258)..(258): n is a, c, g, or t
  modified_base (283)..(283): a, c, t, g, unknown or other
  misc_feature (283)..(283): n is a, c, g, or t
  modified_base (305)..(305): a, c, t, g, unknown or other
  misc_feature (305)..(305): n is a, c, g, or t
  modified_base (402)..(402): a, c, t, g, unknown or other
  misc_feature (402)..(402): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagctctcctgtgcagcctntggattccaccttcagttattttangctatcgctacgttcgggtccncgacggcctaccgaaggggaacgggtactagggtaattagtgtctacgtaggtaattaggaaagttaatggacgtaataaactattaattaattaanagtaacctaaactcgtagtaggtaacgggactaagtactttacaccctagttccctaccgaagggtaacctaaacgttacccgaaacgaaacgtaacccgtacgttagttaactttacctttaacggaaaacgttcggggaacctacgggtaaccgttagggaacgacggtaccgtacgggaaccgggaaccgtaacgggtaccttaggttaacttaggtttaccgtaaggggtcggggttaaggaagggttaacgggacgggttaaaggtttcggggaaacggttttaacgggggtttgggtaccgggggtaccgtaacgggggg

SEQ ID NO: 268141 - DNA, 552 bp, Homo sapiens
  misc_feature: GYAE6OF02G151X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtcccgccaggctccgaggggaagggactggaatatgtctcaggtattagaagtaatgacgaataacatatattatgacaaactctgtagaagggcagtattcaccatcctccagggacaattaccaaagaaccacgctagtacttcttacaaatgggacagcctgagagcgtgaggacgacggctagtatattacgtggtagggagtagggagacggtaagttgggaacgttaggggtttggtcggggcgtaacgggg

SEQ ID NO: 268142 - DNA, 672 bp, Homo sapiens
  misc_feature: GYAE6OF02IL894.28.57.F02.1.454.CMB.1.raw
  modified_base (198)..(198): a, c, t, g, unknown or other
  misc_feature (198)..(198): n is a, c, g, or t
  modified_base (288)..(288): a, c, t, g, unknown or other
  misc_feature (288)..(288): n is a, c, g, or t
  modified_base (522)..(522): a, c, t, g, unknown or other
  misc_feature (522)..(522): n is a, c, g, or t
  modified_base (541)..(541): a, c, t, g, unknown or other
  misc_feature (541)..(541): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggnggagtcgtggggagcttggtccagccgtgggggtccctgacgactctcctgtgcacgcctcgtggactttccacctttcagttattttangtctatcgctacgtcgggtcccgccgacgggtcctacccggaagggggaaacggggtaccgtaggtaaacttgttacgttaccgtacggtaagggtttaagtaaaggtaaaagttaagtaacggtaaacgtaaaataacgtaatttaatttagttaatacgtaaactaacgttgtagtaaggacggactagtactaccaactctccgtacggagtactaacgtaaccgaacacncgtattgtactccgttaanacggtacgcacgtcgagacgcgtacgagagtaaccgtcgtacgttatacgttattacgggtggtagggaaggacggtagtacggttaagtacggggtaacgttaggggtgggtacccggggagtaccgggg

SEQ ID NO: 268143 - DNA, 590 bp, Homo sapiens
  misc_feature: GYAE6OF02IBS07.28.57.F02.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (370)..(370): a, c, t, g, unknown or other
  misc_feature (370)..(370): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggattcaccttcagtatttangctatgcacgtgggtccnccaggcctccgaggggaggactggaatatgtctcgaggtattagaagtatgacgtaataacatatattatanactaactctgtagaagggacagtatccacatctaccgaggactaactaccaacgaaccactcgtatacttacttacaaacgtacgggcaacgtccgtagacgagcggtgaacggaacgccgtcgttatagttaactttcggagggttaggacggaagggacggtagggttaagttagggtaaaccggttaggggttgggttaccggggccgtaacggggg

SEQ ID NO: 268144 - DNA, 573 bp, Homo sapiens
  misc_feature: GYAE6OF02GZYA1.28.57.F02.1.454.CMB.1.raw
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (439)..(439): a, c, t, g, unknown or other
  misc_feature (439)..(439): n is a, c, g, or t
  modified_base (472)..(472): a, c, t, g, unknown or other
  misc_feature (472)..(472): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttttaaaggtgtccagtgtgaggtgcagctggtggagtcgtgggggaggcttggtccagccgtggggggtccctgagactctcctgtgcagcctctggattcaccttcagttatttatgctatgcacgtgggtccgccgaggcctccgaggggaagggacgtaggaactagtgtctacgaggttattagaagtatagacgtaataactatatattanagacaactntagtagaaggcagtcttacactatccacgaggacattaccaagacncgatagtactctacaagtcggcagcctagacgngtacgtgaaggaccgacggtctagtacttagttacgtgggtaggagagggacgtacggtaagttacgggtaagttacggggttggacggggtacgacgggg

SEQ ID NO: 268145 - DNA, 649 bp, Homo sapiens
  misc_feature: GYAE6OF02IH2LZ.28.57.F02.1.454.CMB.1.raw
  modified_base (286)..(286): a, c, t, g, unknown or other
  misc_feature (286)..(286): n is a, c, g, or t
  modified_base (306)..(306): a, c, t, g, unknown or other
  misc_feature (306)..(306): n is a, c, g, or t
  modified_base (519)..(519): a, c, t, g, unknown or other
  misc_feature (519)..(519): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccaggccgtggggggtccctggagactctcctgtgcagcctcgtggattccaccttcagttatttangctatgctacgtcgggtccnccgaggctaccggaaggggaacggctaggaatacgtgtctgaggtatagaagtatgactaataacatatattagtagactaatctagtaggaaggcagtattccacatctaccggaaggtaactaacgttaccgaaagaaccgtacgacttagtaacttccttaagaaagtccgggacaacgtcccgtagacggagtcgtacggacggtaacncgggtcttaaggtaattacggttaaccgtgggtaacgggtacgggtaacggaacggttaaccggggttagttaaaccggggtaaccggtttaggggggttaccgggacgggggtaacccgtaaacggggg

SEQ ID NO: 268146 - DNA, 591 bp, Homo sapiens
  misc_feature: GYAE6OF02IUMR8.28.57.F02.1.454.CMB.1.raw
  modified_base (351)..(351): a, c, t, g, unknown or other
  misc_feature (351)..(351): n is a, c, g, or t
  modified_base (379)..(379): a, c, t, g, unknown or other
  misc_feature (379)..(379): n is a, c, g, or t
  modified_base (438)..(438): a, c, t, g, unknown or other
  misc_feature (438)..(438): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgctatgcacgtgggtccacaggcctccgaggggaaggactggaatatgtctcaggtattagaagtangacgaaataacatatattatgacaactntagtagaagggcagtatcacatccacgaggacattaccaaagaccagctagtatcttanaaagtgggacagcctggaagtgctaggacggacacgggtcttagtattacgttacggttagggtagggaacggtaagggacggtacgggtaacgtttacgggaaaccgggtttagggggtttacggggtacggggggtacccgtaacgggggg

SEQ ID NO: 268147 - DNA, 545 bp, Homo sapiens
  misc_feature: GYAE6OF02G1B8B.28.57.F02.1.454.CMB.1.raw
  modified_base (405)..(405): a, c, t, g, unknown or other
  misc_feature (405)..(405): n is a, c, g, or t
  modified_base (473)..(473): a, c, t, g, unknown or other
  misc_feature (473)..(473): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccaggccgtggggggtccctgagactctcctgtgcagcctctggattccaccttcagttatttatgctatgcacgtgggtcccgccaggcctccgaggggaaggactggaatatgtctcaggtattagaagtaatgacgaataacataatattatgactaaatctgtagagggcagattcacatcncaggacaagtaccaagacacgctagtatctacaaagtgggacagcctagagagcgtagagacgacggntagtatatacgtggtaggaggaggagacggtagttacggaacggttagggttgggtacgggacggtaacggg

SEQ ID NO: 268148 - DNA, 549 bp, Homo sapiens
  misc_feature: GYAE6OF02GB2MM.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtatagaagtaatgacgaataacatatattatgacaaactctgtgaagggcagattcaccatctacaggacaattccaagaacacgactgtacttcttacaaagttcgggacaggcctaggagtagcgtagaggacacggtctagtatattacgtggtagggagaggagacggtaagttcgggaaccgttagggttcggtaggggccgtaacgggg

SEQ ID NO: 268149 - DNA, 602 bp, Homo sapiens
  misc_feature: GYAE6OF02GK89J.28.57.F02.1.454.CMB.1.raw
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtgctattttaaaggtgtccagtgtgaggtgcagctggtggagtcgtgggggaggcttggtccagccgtggggggtccctgagactctcctgtgcagcctctggattccaccttcagttatttatgctatgcactggggtcccgccagggcctccgaggggaagggacgtaggaatagtgtctcgaggtattagaataatgacgaataacagttaatattatgactaaactctagtaggaagggctaagtacttccaaccatccgtaccgagggtaaacaacgttaccaaacgaaccagctagtacttcttaacaaagtgggactagccgtgagngacgtagaggaccagggcttagttatacgttacgtgggtacgggagtagggaacggtacggtaaggttacgggtaacggttagggggtttggtacgggggccgtaacggggg

SEQ ID NO: 268150 - DNA, 646 bp, Homo sapiens
  misc_feature: GYAE6OF02IXD1F.28.57.F02.1.454.CMB.1.raw
  modified_base (240)..(240): a, c, t, g, unknown or other
  misc_feature (240)..(240): n is a, c, g, or t
  modified_base (281)..(281): a, c, t, g, unknown or other
  misc_feature (281)..(281): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgngactctcctgtgcagcctctggattcaccttcagtatttangctatgcacgtgggtccgccaggctccgagggaagggctggaatatgtctcaggtatagaagtatagcgaataacataatattatgactaaactctgtaggaacgggcagtattcaaccatctaccgagggtaacaacttacccaaagaacacgacgttagttacttaccttaccgaaagtcgggacacgtacccgtaggtaacggacgtacgtcgggaaacggaccgaacggtacgtacgttattaacgtttacggagggttaacgggggaacggtaagggtaacgggtacgggttaaacggtttacggggttaaaccggtttagggggtttacggggtcgggggggtacccctaacggggggg

SEQ ID NO: 268151 - DNA, 551 bp, Homo sapiens
  misc_feature: GYAE6OF02I6HTA.28.57.F02.1.454.CMB.1.raw
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
  modified_base (475)..(475): a, c, t, g, unknown or other
  misc_feature (475)..(475): n is a, c, g, or t
  modified_base (509)..(509): a, c, t, g, unknown or other
  misc_feature (509)..(509): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttggtccagccgtggggggtccctgagactctcctgtgcagcctctgattcaccttcagtatttatgctatgcacgtgggtcccgccgaggcctccgaggggaacgggactagggaatatcgtctcgaggttattaagaagttaatgacgaaataacattaattattatgactaaactctgtagaagggcagtatcacatctacgaggacaataccaaagacacgctgtactcttacaagtcggnacgctgagngcgngacggacacggcttagtatagtcgtggtgggagnggagaggtagttggtaacgttgggtggtcggggacgtacggg

SEQ ID NO: 268152 - DNA, 574 bp, Homo sapiens
  misc_feature: GYAE6OF02GFH9N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccaggggaaggactggaatatgtctcaggtattagaagtaatgacgaataacatatattatgacaaactctgtgaagggcagattacaccatctaccgagggactaacttaccaagaaccacgtctagtatcttacaaagtcgggacagccctaggagagctaggaacggacacgggctggtacttagttacgtggtacggggaagagggacggacgggtaagtttgggaaaccggtttaggggttcgggtagggggacccgtaaggggg

SEQ ID NO: 268153 - DNA, 578 bp, Homo sapiens
  misc_feature: GYAE6OF02HK8EL.28.57.F02.1.454.CMB.1.raw
  modified_base (283)..(283): a, c, t, g, unknown or other
  misc_feature (283)..(283): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattcaccttcagtatttangctatgcacgtcgggtccgccaggctccgaaggggaagggactggaatatgtactcgtaggtattaagaagtaatgacgtaataacatattatatgacaaactctggtagaagggtcaagtatcaaccatcacgtaggactaataccaaagacacgtctagtactctaacaagtacggacagccgtgacgagtcgtagacggtacaaccggtgttagtacgttatacggtggtagggaggtaacgggacgtagggtagttacggaacggttggggtaggtcggggacgtacgggg

SEQ ID NO: 268154 - DNA, 569 bp, Homo sapiens
  misc_feature: GYAE6OF02GU66S.28.57.F02.1.454.CMB.1.raw
  modified_base (338)..(338): a, c, t, g, unknown or other
  misc_feature (338)..(338): n is a, c, g, or t
  modified_base (398)..(398): a, c, t, g, unknown or other
  misc_feature (398)..(398): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctggggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccaggccgtggggggtccctgagactctcctgtgcagcctctggattcaccttcagtatttatgctatgcactgggtcccgccaggcctccgaggggaaggactggaatatgtctnaggtattaagaagtaatgacgaaataacatattattatgactaaactctagtagaagggnagattaccaccatctaccgaaggacaacttccaaagacacgctagtactctacaagtgggcagcctagagancgtagacggacacgggtctagtatattacgtgggtagggaagagggtagtaggtaagttagggtaacgttagggggttaggtcggggacgtaacggggg

SEQ ID NO: 268155 - DNA, 560 bp, Homo sapiens
  misc_feature: GYAE6OF02FSELR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggcctccgaggggaaggactgggaatatgtctcgaggttatagaagtaatgacgaataacataatattatgacaaactctgtagaagggcagtattcacctatctacgaggaccaattaccaaagaccacgactgtatacttacaaagtgggacagcctgagacgcgtagacggacacggtacttgtacttagtacgtggtacgggagaggaggacggtaagttcgggaagttggggttggtcggggaccgtaacgggg

SEQ ID NO: 268156 - DNA, 602 bp, Homo sapiens
  misc_feature: GYAE6OF02GLYCN.28.57.F02.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
  modified_base (359)..(359): a, c, t, g, unknown or other
  misc_feature (359)..(359): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctcgtggacttccaccttcagttatttatgctatgcacgtgggtccnccaggctccgaggggaaggactggaatntgtctacgtaggtattagaagttaancggacgtaaataacgattattattatgactaaactctgtagagggcagtactcacatctcgaggtacaacttccaaagacacgtcttagtaacttcttaacaaagtcgggactacggcctagagacgcgtaggaacggacgacggtctagttacttagttacgtgggttaggggaacgaggggacgtagggtaaggtttacgggaacggtttagggggttggtaccgggggccgtaacggggg

SEQ ID NO: 268157 - DNA, 615 bp, Homo sapiens
  misc_feature: GYAE6OF02IFT5O.28.57.F02.1.454.CMB.1.raw
  modified_base (264)..(264): a, c, t, g, unknown or other
  misc_feature (264)..(264): n is a, c, g, or t
  modified_base (376)..(376): a, c, t, g, unknown or other
  misc_feature (376)..(376): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggnttcaccttcagtattttatgctatgcactgggtccgccaggcctccgaggggaagggactaggaatagtgtctcgaggttattagaagtaagtgacgaataacatatattangtacaactctgtagaagggcagattccacacttcaccgagggaacacttaccaagaaccacgtctagtacttccttacaaagtcgggacagccgtagagtagacgtaggaacggacgaccggtctagttactacgtttaacggtggttacggggaggtaaggggtacgtaacgggtaaggtttaacgggtaaacgggtttagggggtttacgggttaccgggggtacggtaacgggggg

SEQ ID NO: 268158 - DNA, 616 bp, Homo sapiens
  misc_feature: GYAE6OF02G1LJA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaaggtgtccagtgtgaggtgcagctgggtggagtcgtgggggaggcgttggtccagccgtggggggtccctggagactccgtcctgtgcacgcctctggatttccaccttcagttatttatgactatgcactgggtcccgccaggcctccgaaggggaagggactagggaatagtgtctcgtaggttaataggtaaagtataggacgaaagtaacataatattatgtactaaaactctagtaggaagggtacagtacttaccgacctactactccgaaggactaacttaccgaaacgaacacgtactacgttaactccgttaataaactgggacagtacccgtagagacgcgtagtacggacgacgcgttagtatattagtggtaggaggtaggaaggtacggtaaggtggtaacggttagggttcgggtacgggacggtaacgggg

SEQ ID NO: 268159 - DNA, 786 bp, Homo sapiens
  misc_feature: GYAE6OF02G34ZF.28.57.F02.1.454.CMB.1.raw
  modified_base (354)..(354): a, c, t, g, unknown or other
  misc_feature (354)..(354): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtcgtgggggaggcttggtccagccgtggggggtccctgagactctcctgtgcagcctctggattcaccttcagttatttatgctatgcacgtggggtccgccaggcctccgaggggaagggctggaatatgtctcgaggtattaagaagtaangacgtaaataaacataattaattatagactaaaacttcgtaggtaggaaacggggactaaggtactttaccaaccctacgttaccgttacccggaaacgggtaaacctaaaacgtttaccccgaaaacggtaaaccctaaccggtacccgttttaagttaaccgtttaccgtttaaacccgtaaaaggtttccggggaccgtaacgggtacccgttagggaacggtaccggacgtttacgggaacgggtaaaccgtaccggggttaccttaaggttaacgttttaacggtttacggttaggggtttaacggggggaaggtaacgggggtaaaccggttaacgggggttaaacggttttacgggggttaaaacggggttttacgggggggtttacgggggttaccgggggggacccgggttaaaccggggggg

SEQ ID NO: 268160 - DNA, 573 bp, Homo sapiens
  misc_feature: GYAE6OF02ILLYC.28.57.F02.1.454.CMB.1.raw
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttangtctatgcactgggtccnccaggctccgagggaaggctggatatgtctcagtatatagaatagngactaanatattatatagtagaactaatctaggagggacgagtagtctaccactactccacggaagaactactaacgaaacgacacgtatatcttactaaactaggcgacgacgttcgagaagtgtacgtaggacgtaccggcgtagtagttaattacgttggtaggagggtaggaggacggtacgttaagggtacggttagggtagggttcggggacggacgggg

SEQ ID NO: 268161 - DNA, 562 bp, Homo sapiens
  misc_feature: GYAE6OF02JEWZ7.28.57.F02.1.454.CMB.1.raw
  modified_base (300)..(300): a, c, t, g, unknown or other
  misc_feature (300)..(300): n is a, c, g, or t
  modified_base (361)..(361): a, c, t, g, unknown or other
  misc_feature (361)..(361): n is a, c, g, or t
  modified_base (372)..(372): a, c, t, g, unknown or other
  misc_feature (372)..(372): n is a, c, g, or t
  modified_base (451)..(451): a, c, t, g, unknown or other
  misc_feature (451)..(451): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattccaccttcagttatttatgctatgcactgggtccncaggcctccgagggaaggactggaatagtgtctcgaggtattagaagtatagacgaataanattaatattangacaaactctgtagagggcagtatcacatctacaggacaataccaacgaacacgactagttactcttacaagtggtacngacctgacgagctgaacggacacggtctagtattagttacgtgggtacgggaggaggaggtacgggtaagttagggtaacggttaggggtcggttacggggaccgtagggg

SEQ ID NO: 268162 - DNA, 582 bp, Homo sapiens
  misc_feature: GYAE6OF02G8VBP.28.57.F02.1.454.CMB.1.raw
  modified_base (382)..(382): a, c, t, g, unknown or other
  misc_feature (382)..(382): n is a, c, g, or t
  modified_base (456)..(456): a, c, t, g, unknown or other
  misc_feature (456)..(456): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttattttatgctatgcaagtggggtcccgccaggcctcccgaggggaagggactggaatagtgtctcgaggttattaagaagtaatgacgaaataacatataattangacaaactcgtgtagaagggcagtatccaccatccaccgaaggactaactaccaagaaccacgctagtatctanaatgggacagcctagagacgngtagacggacgacggngtacgtattagtacgtaggtagggaggaacggtaggacggtaacgtttagggaacggttaggggtacgggttcggggaccgtacggggg

SEQ ID NO: 268163 - DNA, 584 bp, Homo sapiens
  misc_feature: GYAE6OF02JDYSH.28.57.F02.1.454.CMB.1.raw
  modified_base (369)..(369): a, c, t, g, unknown or other
  misc_feature (369)..(369): n is a, c, g, or t
  modified_base (495)..(495): a, c, t, g, unknown or other
  misc_feature (495)..(495): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcttggtccagcctggggggtccctgagactctcctgtgcagcctctggattcaccttcagttatttatgcttatgcacgtggtccgccaggcctccgagggaagggctggaatatgtctcaggttattagaagtaatgacgaataacataatattangacaaactctgtagaagggcagtacttccacctatccgtaccgaagggaacctaattaccaaagtaaccacgtcttagtactcttacaaagtcgggactaggcctgacgagactgaggacacgggnttagtatagttacgtggtagggaaggtggaaggacggtaagtttacggggaacggtttagggggttcggtacgggggccgtaacggggg

SEQ ID NO: 268164 - DNA, 882 bp, Homo sapiens
  misc_feature: GYAE6OF02GUIXD.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggagtcgttggtccagccgggttcggggggtccctggacgtaccttcctccgtggtcgcacgtccctcgtggtacttccaccctttcgaagtttacttttaatcggtccttaagtgcctacggttcggggtccccgcccgagggtcctaccggaagggggaacgggtaccgtagggtaaattagttggttcctcgtaaggtttaagttaaggtaaaggttaagtggaacgtaaaacttaaactaattaatttaatttaagtacgtaacctaaaacgttcgttagggtagggaaacgggtcaaggtacttacccaacctacttcccgtaccggaacgggtaaacctaaacgttacccgaaaacggtaaaccgaaccgtaccgttaggttaacttacccgtttaaactaaaacgggttcgggtaaccgtaaccgggtcccgttaagggtaacgggtaacggtaccggttaacggggaacgggtaaacccggaaccggggttaccgttaaggttaacttttaaccggttttaccggttaggggttaacggggggtaagggaacgggggtaacggggttaacggggttaaacgggttttaacgggggtaaaccggggtttttaagggggggtttacgggggggttaccgggggtaacccgggggtaacccggggggg

SEQ ID NO: 268165 - DNA, 729 bp, Homo sapiens
  misc_feature: GYAE6OF02JHZBF.28.57.F02.1.454.CMB.1.raw
  modified_base (287)..(287): a, c, t, g, unknown or other
  misc_feature (287)..(287): n is a, c, g, or t
  modified_base (659)..(659): a, c, t, g, unknown or other
  misc_feature (659)..(659): n is a, c, g, or t
tcagagtacgctatcacgaccggtgctcgatttagctcgatatagttgggtctgggagaggagcccccgccctcgggtttcccaggtgttctcatttggtgatcagcactgcacacagaagagtcatgacggagtttgggctgagctgggttttccttgttgctattttaaaggtgtccagtgtgaggtgcagcgtggtggagttcgtgggggaggcttgggtccagccgtggggggtccctgagactctcctgtgcagcctctggattcaccttcagttattttancgctatcgctacgtggggttcccgccgacggccttccggaaggggaacggggacctagggaattatcggtacttccgtaagggttattaaaggtaacgtaagtggtaaccgaaaactttaacgatttaattaaagttttacgaggtaacctaaaaccgtttctagggttaaggaacggggtaccaaggtatttacccaaaccctagttacccgtacccgtaaacgggaacctaaacgttaacccgaaagaaccgtacgtcgttaacgttacgttacgtaacgtaaagtccgggataacggccttaggagtacgtacgagggtaacggtaccgaacggtcttacggttatagttaccggttaaggtacggggngggtaagaacgggtagttaaacggttacgggtaacgttaaggggggtcttaccgggggacggtaacgggg

SEQ ID NO: 268166 - DNA, 696 bp, Homo sapiens
  misc_feature: GYAE6OF02HIYAR.28.57.F02.1.454.CMB.1.raw
  modified_base (379)..(379): a, c, t, g, unknown or other
  misc_feature (379)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctcgtggacttcaccttcagttatttatgctatgctacgtgggtcccgccgaggccttaccggaaggggaaggggtacctagggaatagttgtactcgtaaggttattaaggaaagttaanaggaacgtaaataactaattatttattaatacgaactaaactcgtaggtacggaagggtctaagtacttaccacctattccacggaaggaactaacgttaccaaagtaccgaacgtactttagttaacttaccttaagtaaacgtcggaactacgtcccgtaagggacgacgttacgacggaacggggtaccaacgggttacttaggtttaacttacggtttacgggtaggtacgggaagggtaaggacgggtaaggtacggttaagggtaaccgggtttaggggtttacggggtaccggggaccggtaaccggggg

SEQ ID NO: 268167 - DNA, 620 bp, Homo sapiens
  misc_feature: GYAE6OF02H67RS.28.57.F02.1.454.CMB.1.raw
  modified_base (392)..(392): a, c, t, g, unknown or other
  misc_feature (392)..(392): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttttaaaggtgtccagtgtgaggtgcagctggtggagtcgtgggggaggcttggtccagccgtggggggtccctggagactctcctgtgcagcctctggattcacctttcagttatttatgactatgccacgttcgggtccgccagggcctccggaaggggaacgggacgtggaattagtgtctcgaaggttataagaagtaatgacgaaatacatattattanagactaaactctagtaggaagggctagtacttcgaactactccacgacggactaacgttaccaaagacacgcttagtactcttaacgaaatgggacagtcctgacgacgacgtgaacgacgtaacggtcgtagttagttacgtttaacggtgggtagggaaggtaacgggagaccgggttaaggtacggggaagtttagggggttcggtacgggggacgtaacggggg

SEQ ID NO: 268168 - DNA, 743 bp, Homo sapiens
  misc_feature: GYAE6OF02HB8WV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggcctgggggggtccctggagactctcctgtgcagcctctggattcaccttcagttatttatgctatcgcacgtcgggttcccgccgtaggcctaccgaaggggaagggacctagggaattatggtactcgaaggttacttaaggaagtaatgacgtaaataaacattaattattaactgaacaaacttctaggttaggaaacgggtcaaggtacttccgaacctagttacctaccgaacggggtaacctaaacgttacccgaaaagtaaaccgaacccggtactacgttaacgttacctttaacgaaaacgttcggggaacctacggtacccgttaggaacggtaacggtaccgtagggtaaccgggaaccgtaccgggttacttacgggttaacttacggttttaacggtaggggtttacggggaaaggtaacggggtaacggtaacgggttaaacggtttacggggtaaacggtttacgggggttacggggtaccgggggtacccggtaacgggggg

SEQ ID NO: 268169 - DNA, 614 bp, Homo sapiens
  misc_feature: GYAE6OF02F44CG.28.57.F02.1.454.CMB.1.raw
  modified_base (334)..(334): a, c, t, g, unknown or other
  misc_feature (334)..(334): n is a, c, g, or t
  modified_base (546)..(546): a, c, t, g, unknown or other
  misc_feature (546)..(546): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtgggggggtccctgagactctcctgtgcagcctctggattcaccttcagttatttatgctatgcacgtgggtcccgccaggcctccgaggggaagggactggaatntgtctcgaggttataagaagtaatgacgaataacatattattatgtacaacttcgtaggtaggaacgggctaagtacttaccactactcctccgaagggactaacttaccaaacgaccacgtcttagtacttacttacaaagtcgggacagacctaggacgagcgtaggaacggactacggctacgttatacgttacgtgggtagggaacgngggacggtaacgggtagttacggggtaaccggttagggggtttacggtacggggaccggtaacggggg

SEQ ID NO: 268170 - DNA, 589 bp, Homo sapiens
  misc_feature: GYAE6OF02FR00P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcacctttcagttatttatgctatgcactgggtccgccaggcctccgaggggaaggactgggaatagtgtctcgaggttatagaagtatgacgaataacattatattatgactaaactctagtagaagggcagtattcacctatcctaccgagggacctaattacccaaagaaccacgctagttacttccttacaaagtcgggacagccgtgagagctggacgacacggcttagttatagttacgtggtagggaacggagggacggtacgggtaagtttacgggtaaacggtttagggggtttcggtacgggggaccgtaacggggg

SEQ ID NO: 268171 - DNA, 581 bp, Homo sapiens
  misc_feature: GYAE6OF02HUH2K.28.57.F02.1.454.CMB.1.raw
  modified_base (282)..(282): a, c, t, g, unknown or other
  misc_feature (282)..(282): n is a, c, g, or t
  modified_base (365)..(365): a, c, t, g, unknown or other
  misc_feature (365)..(365): n is a, c, g, or t
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtcccctgagactctcctgtgcagcctctggattcaccttcagtatttangctatgcactggtccgcaggctccgagggagggctggaatatgtctcgaggtatagaagtaatgacgaataacatattattangactaaactctagtagaaggcaagtattacaaccatacctccgaagggaactaacgttaccaaagaaccacggactagtaacttcttacgaaagtcgggacacggtcctaggacgngacgtaggacggacgacggtctagtattacgttacgnggtagggaggaggtagacggtaagttacgggaaccgttagggtcggtggggaccgtaacgggg

SEQ ID NO: 268172 - DNA, 774 bp, Homo sapiens
  misc_feature: GYAE6OF02HLR8E.28.57.F02.1.454.CMB.1.raw
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttangctatgcactgggtccncaggcctccgagggaaggactggaatatgtctcgaggtattagaagtaatgacgtaaataactataattaattagtgaactaaaacttcgtaggtaggaaacggggtctaaaggtactttacccgtaacccgtaactttccccgtaacccggtaaacggggtaaaccttaaaacgtttaccccgaaaaaacggtaaacccgaaccggttaccgtttacggttaaaccttttccgttaaacccgtaaaaggttcgggggtaacccaacggtaccctagggaaacgtacgtaccggttaagggaaacggggtaacccgtaacgggtacccgttaaggttaactttaacggttttaccggtttagggggtacggggtaagggtaacggggtaacgggggtaacgttaaacgggttaggggtaaacccggtttaggggggtttaacggggttaccggggggacccgtaaaccggggggg

SEQ ID NO: 268173 - DNA, 575 bp, Homo sapiens
  misc_feature: GYAE6OF02HJ5H1.28.57.F02.1.454.CMB.1.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (413)..(413): a, c, t, g, unknown or other
  misc_feature (413)..(413): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcaccttcagtatttangtctatgcacgtgggtccnccaggcctccgagggaaggactggaatagtgtcgtgaggttattaggaagtaagtgacgtaataacataatattatgacaaactcgtgtagaagggcagattaccacatcncgaggacattaccgaagaacacgtctacgtacttacttacaagtggacacgctgagnggtctacggaaggaccgacggtctagttattacgttacgtggtagggaagtagggagacggtaagttacgggtaacggttgggtagggtcgggacggtaacgggg

SEQ ID NO: 268174 - DNA, 642 bp, Homo sapiens
  misc_feature: GYAE6OF02J005X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagccgtggggggtccctgagactctcctgtgcagcctctggattccaccttcagtatttatgctatgcactggtccgccaggctccagggaaggctggaatatggtctcgaggtataagaagtagtgacgaaatacatatattatgactaaaactcttagtaggaagggctaagtacttaccacctagtccgtaccgaagggtaactaaacgttaccaagaaaccacggtcctagtacttccttaacaaagtcgggactacgtaccctagtaacgagtacccgttagaacggaaacccgaccgggtaccgttagtaacgttagttttaccgtaggggtagggtacggaagggtaaggaccgggttaagttacggggtaaaaccgttaggggggttttgggacgggggtacccctaagggggg

SEQ ID NO: 268175 - DNA, 550 bp, Homo sapiens
  misc_feature: GYAE6OF02GWOLH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggctccgagggaagggactggaatatgtctcgaggtattagaagtaatgacgaataacataatattatgacaaactctagtagaagggcagattacacatctcgaggacaattaccaagaaccacgctagtactcttacaaatgggacagcctgagagctagacggacacggctagtatagttacgtggtagggaggaggaggaggtaagttagggtaacgttaggggttggtcggggacgtaacgggg

SEQ ID NO: 268176 - DNA, 705 bp, Homo sapiens
  misc_feature: GYAE6OF02ISW69.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcacctttcagttattttatgctatgcacgtcgggtccgccgaggctccgaggggaagggactaggaatgtgtctacaggtatagaagtatgacgaataacatattattatagactaaactctggtaggaagggcaagtacttaccaaccgtacttccgtaccgaaggggaacctaaacgtttaacccaaacggtaaacccgaaccggtaccttaggttaacttaccctttaactaaaaggtcggggtacaaccggtaccgtagaagggacgtcggtacgggaaacgggaacccgtaacgggtacgtttacggttaactttaacgttttaaccggtcgggttaagggggaaggaacgggtaacggggaacgggttaaaggtttacggggtaaaccggtttaggggggtttacgggttacggggggacccggtaacgggggg

SEQ ID NO: 268177 - DNA, 520 bp, Homo sapiens
  misc_feature: GYAE6OF02FMMJC.28.57.F02.1.454.CMB.1.raw
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (346)..(346): a, c, t, g, unknown or other
  misc_feature (346)..(346): n is a, c, g, or t
  modified_base (429)..(429): a, c, t, g, unknown or other
  misc_feature (429)..(429): n is a, c, g, or t
  modified_base (485)..(485): a, c, t, g, unknown or other
  misc_feature (485)..(485): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctgggggtccctgagactctcctgtgcagcctctggattcaccttnagtatttatgctatgcactgggtccnccaggctccgagggaaggactggaatatgtctcaggtattagaagtaangacgaataacatatattatgacaaactctgtagaagggcagatcacatctcgaggacaatccaaagacacgctagtactctanaaatgggacagctgagagctgagacacggtctgtatattacgtggtcgggagaggngacggtattcggaagtgggttgtgggacctagggg

SEQ ID NO: 268178 - DNA, 612 bp, Homo sapiens
  misc_feature: GYAE6OF02IY9ST.28.57.F02.1.454.CMB.1.raw
  modified_base (307)..(307): a, c, t, g, unknown or other
  misc_feature (307)..(307): n is a, c, g, or t
  modified_base (358)..(358): a, c, t, g, unknown or other
  misc_feature (358)..(358): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctattttaaggtgtccagtgtgaggtgcagctggtggagtcgtgggggaggcgttggtccaggccgtggggggtccctgagactctccgtgtgcagcctcgtggacttcgaccttcagttatttatgctatgcacgtgggtcccncaggctccgagggaaggactggaatatgtctcgtaggtaattagaagtaangacgaaataacatataattatgaactaacgttactggtaggaacgggtcaaggtactttaccgaacctagttcctaaccggagggtaacctaaacttcccgaaaataaccacgtctcggtaactacttacaaacgtggactagaccgtagacgagtcctaggaacgcaacggtctagtattacgtagtcggtaggaggtaggacgtaggtaagttcgggtaacggttgggtacggttacggggacgtaacgggg

SEQ ID NO: 268179 - DNA, 690 bp, Homo sapiens
  misc_feature: GYAE6OF02GX1WQ.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctcctgtgcagcctctggattcaccttcagtatttatgctatgcactgggtccnccgaggcctccgagggaagggactaggaatagtgtctcgaggtataggaagtatgacgtaataacgattatattagtagactaaactcgtgtaggaagggactaaggtatttaccaagttctaacttcccgtaccgtaaggggtaaacctaaacgtttacccgaaagtaaaccgaaccgtacttacgttaaccttcgtttaacaaacggttcgggacctaacgggttacccgtaggtaacggaacggtcttaacgggaacggtaaccgacgggttaccgttaggtaagtttaacgttaacggttgggaaggggtaacggtaaggggtacggtaaccggggtaagtttacggggtaaacggtttacgggggttcgggtagggggtaacccggg

SEQ ID NO: 268180 - DNA, 800 bp, Homo sapiens
  misc_feature: GYAE6OF02JPU73.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcgttggtccagccgtggggggtccctgagactctcctgtgcagcctctggattcaccttcagtatttatgtcttatcggctacgttcgggtcccgccgaggtcctccgaaggggaacggactgggaatagtcggtctacgtagggttattaggaaagttatagaccgtaaaattaaacgaattaattaagtttatacgtaacgtaaaacttcgtaggtacggaaaggggtacctaaaggtactttacccaaccgtagttaccccgtaccggaaacgggtaactaaaaccgttacccgaaaacggttaaaaccacgggttaccctttagggttaaaccctttaccttaacgtaaaacggtccggggtacctaacgggttacccgtagggaaacgaccgtaacggttagggaacgggtaaccgtaaaccggggttgtttaaccggttaattttaaccggtttaaccggttaagggggtaccggggtaagggaaacgggttaacggggtacgggtaaaagggtttttccggggaaaaacggggttttacgggggttttaggggacccggggggttaacctaacggggggg

SEQ ID NO: 268181 - DNA, 607 bp, Homo sapiens
  misc_feature: GYAE6OF02GTDLY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaaggactggaatagtgtctcgaggtattagaagtatgcgaataacataatattatgactaaactctgtagaagggcagattcactatctaccgagggacaacttaccaagaacacgctgtatcttacaaagtggacagcctaggacgtagctaggtacggaaccacgggacttaggttaattaacgtttaccgtgggttaggggtaacggaaggggtaacggtacggggtaaaggtttacggggaaacggtttacggggggtttacgggtaccggggggtaccggtaacgggggg

SEQ ID NO: 268182 - DNA, 605 bp, Homo sapiens
  misc_feature: GYAE6OF02HT1U7.28.57.F02.1.454.CMB.1.raw
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaggtgtccagtgtgaggtgcagctggtggagtcgtgggggagcttggtccagccgtggggggtccctgagactctcctgtgcagcctntggattcaccttcagtatttangctatgcactggtccgccaggctccgagggaagggactggaatatgtctcaggtattagaagtaatgacgaataacataatattaatgactaaactctagtagaaggggcaagacttccaacctatctaccgaagggaactaacgttaccgaaacgaaacaccgacgtttagttaacgttcttaacaaagttcgggacacgtccgtaggaagacggtcgtaggaacggacacgggtctagtagttacgttacgtggtaggggagaagggaggacgggttaacgttaggaacggttaggggtttacggtcgggggacctaacggggg

SEQ ID NO: 268183 - DNA, 660 bp, Homo sapiens
  misc_feature: GYAE6OF02GWLIL.28.57.F02.1.454.CMB.1.raw
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctgggggggtccctggagactctcctgtgcagcctctggattcaccttcagttatttatgctatgcactgggtcccncaggctccgaggggaagggactggaatatgtctcgagggtattaaggaagtatgacgaaataacatagtattactgacaaactntgtaggaagggtcagtattcacctatctaccgaggactaacgttaccaaagaaccacggacttgttaataccttacgaaagtttggggaccacggtacccgttaggaagacggtaccgttagggaaccgggtaaccgaaccggggtctttaggtaacgtttagtttaaccgggttgggtaaagggggaggtaacggggtaacgggtacggtaaggttttacgggggtaaaccgttaggggggtttacggtacggggggtacccgaacggggggg

SEQ ID NO: 268184 - DNA, 533 bp, Homo sapiens
  misc_feature: GYAE6OF02GQEK4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcaggtattagaagtaatgcgaataacatatattatgacaaactctgtgaagggcagattcacatctccagggacaattaccaagaacacgctgtatcttacaatgggacagcctagagagctgagacacggctgtatattacgtggtgggagaggagacggtaagttagggaacgttaggggttggtggggaccgtaacgggg

SEQ ID NO: 268185 - DNA, 525 bp, Homo sapiens
  misc_feature: GYAE6OF02GYQUC.28.57.F02.1.454.CMB.1.raw
  modified_base (487)..(487): a, c, t, g, unknown or other
  misc_feature (487)..(487): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccctgagactctcctgtgcagcctctggattcaccttcagtatttatgctatgcactgggtccgccaggctcagggaagggactgggaatatgtctcaggtattagaagtaatgcgaataacatatattatgacaaactctgtgaagggcagattcacatctccaggacaattaccaagaaccacgctagtatcttacaatgggcagcctgagagctgaggacacggctgtatattacgtgtgggagaggagnggtagttggaacgttaggggttgtaggggccgtagggg

SEQ ID NO: 268186 - DNA, 754 bp, Homo sapiens
  misc_feature: GYAE6OF02IOUBF.28.57.F02.1.454.CMB.1.raw
  modified_base (340)..(340): a, c, t, g, unknown or other
  misc_feature (340)..(340): n is a, c, g, or t
tcagagtacgctatcacgaccggtgctcgatttagctcgatatagttgggtcgtgggagaggagcccccgtccctcgggtttcccaggtgttctcatttcggtgatcagcactgccacacagaagagtcatcgacggagtttgggctgagcgtggttcgtgtagctatttaagtgtcacgtgtgaggtgctagcgtgggtggagtccgtcgggggacgcttcggtccaggcgtcgggggtccctggacgactcgtccgtcgtacgcagtcctcgtacggtacttccgaccttacgtaagttacgtttagtcgtcctaacgtcgtctacgttacggtcccncgtacggtcctaccggagggaacggtcgtaggtactagtcgttactaccgtacgtagtaacgtaacggtactcggacgtaaagtaaccgtagttaagtacttaacgtcgtaaacctaaacgtcgttacgtaacggtaacgggtactaaggtaaccgtttccaaacccgttaacgttccggtaaccgtaaggaaaaccttgttaaaccaaggaaccgtcgtacttagttacttacgtaactaaggtcgtacgcgttaccgaggtaccgtaacgtccgtaagggcccggtaaaggtaccgggtattaaccgggttattaaaccggtacggttaggaaccgggtaacggtaggaacccggtaaaggttcgttacgggtaaacggtttcggggtaccggtaccggggtaccctcgggg

SEQ ID NO: 268187 - DNA, 630 bp, Homo sapiens
  misc_feature: GYAE6OF02IDV03.28.57.F02.1.454.CMB.1.raw
  modified_base (269)..(269): a, c, t, g, unknown or other
  misc_feature (269)..(269): n is a, c, g, or t
  modified_base (400)..(400): a, c, t, g, unknown or other
  misc_feature (400)..(400): n is a, c, g, or t
  modified_base (502)..(502): a, c, t, g, unknown or other
  misc_feature (502)..(502): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctggtggagtcgtggggggaggcttggtccagccgtggggggtccctggagactctcctgtgcagcctctggnttccaccttcagtatttatgctatcgctacgttcgggtccgcccgagggcctcccgaagggggaagggactgggaattatggtctacgaggttaattaaggaattaatgacgaaattaacattatattacngtacaaactctggtagaacgggcagtactacaccatccaccagggaacaacgttaccaagacaacgtctagttatcttacaagtcgggcacgacgtgaacgngacgtagaaggaccgacggtactagttacttaagtttacggtgggtaaggggtaggacgggtaaggacgggttaaggttcgggtaaacgggtttaggggtttcgggtacgggggtaccgtaacggggg

SEQ ID NO: 268188 - DNA, 630 bp, Homo sapiens
  misc_feature: GYAE6OF02IY3VY.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtcccgccaggctccgaggggaagggactggaatatgtctcaggtattagaagtaatgacgaataacatatattatgacaaactctgtagaagggctagactttcaacctatcctcgaagggaacaacttaccaaaggaacacgcttagtactcttaacaaagtcgggacacgtacctaggacgtacgcgtaggaacgggaccacgggtaccttagttaacgttacgtttaagtcgggtacggggaaggaaggggtaacggtaccggggtaaaaggtttcggggaaaaccggtttagggggggtttcgggtaccggggggacccggtaagggggg

SEQ ID NO: 268189 - DNA, 568 bp, Homo sapiens
  misc_feature: GYAE6OF02HZBBU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagtatttatgctatgcacgtgggtccgccaggcctccgaggggagggactggaatatgtctgaggtattagaagtatgacgaataacatatatatagacaactcgtagtaggaagggctagattccacctatctaccgaggaacaacttaccaagaacacgctagtattaccttacaaagtcgggacaggcctagagagcgtagacggacgacggcttagtatacgttacgtggtagggaggaagggagacggtaagttacgggtagttaggggttggtcggggacggtacggg

SEQ ID NO: 268190 - DNA, 662 bp, Homo sapiens
  misc_feature: GYAE6OF02IQLWT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtgggagtcgtgggggaggcgttggtccagccgtgggggtcccgtgagactctcctgtgcacgcctctggattccaccttctagttattttatgctatgcacgtcgggtcccgcccgaggcctccggaaggggaacggggactaggaatagtgtactcgtaggtaagttaagaaagtaagtgaacgtaaataacaattaatttaattagtacgaactaaactcgtagtaggaagggctagtattaccacctatacctccgaagggacctaaattcccgaaagaacctacgacttagtaacttctaaccgtaaagtcgggacgaacgtacccgtaggaacgtaggacgtacggaagggaaccgccggtagttagtactttagtttaccgtagggttcggggaaggtagggacggtagggtagttaagggaccgggttaaggggttgggtcggggtaccgtacggggg

SEQ ID NO: 268191 - DNA, 541 bp, Homo sapiens
  misc_feature: GYAE6OF02FN0ZV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccgccaggctccgagggaagggactgggaatatgtctcaggtattagaagtaatgacgaataacatatattatgacaaactctgtgaagggcagattcacatctccagggacaattccaaagaaccacgctagtactcttacaaatcgggcagcctgagagcgtagaggacgacggctgtatacttacgtggtacgggagaggagacggaagttgggaacgttaggggttggtggggaccgtaagggg

SEQ ID NO: 268192 - DNA, 642 bp, Homo sapiens
  misc_feature: GYAE6OF02F25KT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtcgggtcccgcccgaggccgtccgaggggaacgggacgtggaatagtgttctcgtaaggttattaggaagtaatgacgtaataacatattattatgactaaactcgtagtaggaacgggcagtactcactactcctaccgaaggaactaactttaaccgaaagtaaccgacgtcgttacgttactaccttaacgaaacgtcgggactaacggtcccgtaggacgacgtccgtagggaacggacgacggtcgttagtacttatacggtgggtagggaaggagggtaacggacgggttaaggttacgggtaaacgggttaggggttacgggtacggggaccggtaacggggg

SEQ ID NO: 268193 - DNA, 534 bp, Homo sapiens
  misc_feature: GYAE6OF02F4NI4.28.57.F02.1.454.CMB.1.raw
  modified_base (450)..(450): a, c, t, g, unknown or other
  misc_feature (450)..(450): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggcctccgagggaagggactggaatatgtctcaggtattagaagtaatgacgaataacatatattatgacaaactctagtgaagggcagattcacatctcaggacaattccaagaacacgctgtatcttacaagtgggacagcctgagngctgagacgacggctagtatattacgtggtaggagaggagacggtaagttgggaacgttggggttggtacggggcgtaacgggg

SEQ ID NO: 268194 - DNA, 620 bp, Homo sapiens
  misc_feature: GYAE6OF02I2WCS.28.57.F02.1.454.CMB.1.raw
  modified_base (302)..(302): a, c, t, g, unknown or other
  misc_feature (302)..(302): n is a, c, g, or t
  modified_base (526)..(526): a, c, t, g, unknown or other
  misc_feature (526)..(526): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattccaccttcagtatttatgctatgcacgtggggtcccnccgaggcctccgaggggaagggactagggaatatgtctcgaggttaattagaagtaatgacgtaaataacattaattaattatacgacaaacttctaggtaggaagggcaagtacttaccaacctatcctccgaagggaacctaaacttaccgaaagaaccaccgtactagttataccttaacaaagtgggacacgcctagagacgcgtagaacggacacggtntagtattacgttacgtgggtagggaggaagggaggtacgggtaagttacggggtaaacggttaggggttacgggtcgggggaccgtaacggggg

SEQ ID NO: 268195 - DNA, 596 bp, Homo sapiens
  misc_feature: GYAE6OF02GUGG3.28.57.F02.1.454.CMB.1.raw
  modified_base (301)..(301): a, c, t, g, unknown or other
  misc_feature (301)..(301): n is a, c, g, or t
  modified_base (469)..(469): a, c, t, g, unknown or other
  misc_feature (469)..(469): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctggagactctcctgtgcagcctctggattcaccttcagtatttatgctatgcactgggtccnccaggctccgagggaggactggaatatgtctcaggtatagaagtaatgacgaaataacgataattattatagacaaactctagtagaagggcagattacaccatctcaaggacaattccaaagaacacgactagtaattcttacaaagtcgggacacgcctagaacgngaccgtaggacgaacgacgggtactagttatacgtttacggtggttaacggggaggaacgggtaggtaccgggtaagtttacgggaaacggtttaggggttacgggtacgggggcccgtaacggggg

SEQ ID NO: 268196 - DNA, 568 bp, Homo sapiens
  misc_feature: GYAE6OF02I8OQJ.28.57.F02.1.454.CMB.1.raw
  modified_base (381)..(381): a, c, t, g, unknown or other
  misc_feature (381)..(381): n is a, c, g, or t
  modified_base (453)..(453): a, c, t, g, unknown or other
  misc_feature (453)..(453): n is a, c, g, or t
  modified_base (475)..(475): a, c, t, g, unknown or other
  misc_feature (475)..(475): n is a, c, g, or t
  modified_base (504)..(504): a, c, t, g, unknown or other
  misc_feature (504)..(504): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccgcaggcctccgagggaagggactggaatatgtctcaggtattagaagtaatgacgaataacattatattatgactaaactntagagaagggcagtacttacaccatctaccgaaggaactaacttacaaagaacacgactagtattaccttanaaagtgggaccagtaccagagngtcaggacgacacggtctgtatagttagnggtagggagaaggaggtacggtaacgttaggaacggtttaggggtacggtggggacctacgggg

SEQ ID NO: 268197 - DNA, 617 bp, Homo sapiens
  misc_feature: GYAE6OF02IIIT2.28.57.F02.1.454.CMB.1.raw
  modified_base (288)..(288): a, c, t, g, unknown or other
  misc_feature (288)..(288): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttggtccagccgtgggggggtccctgagactctcctgtgcagcctcgtggattcaccttcagttattttangtctatgcacgtcgggtcccgccgaggcctccggaaggggaacgggacgtaggaatatgtctcgtaggttattagaagtaatgacgaaataacataattattaatgactaaactctgtagaagggcagtatcaccatacctaccgaggtaactaacttaccaacgtaactacgcttacgtattacttaacgtaagtcggacgtacgaccgtaggagtacgtcgtaggacggacgacggtactagtacttatttacggtggttagggaggtagggagtacgggtagttacgggtaacggtagggggttgggacgggtaccggtaacgggg

SEQ ID NO: 268198 - DNA, 595 bp, Homo sapiens
  misc_feature: GYAE6OF02IHOPQ.28.57.F02.1.454.CMB.1.raw
  modified_base (281)..(281): a, c, t, g, unknown or other
  misc_feature (281)..(281): n is a, c, g, or t
  modified_base (379)..(379): a, c, t, g, unknown or other
  misc_feature (379)..(379): n is a, c, g, or t
  modified_base (503)..(503): a, c, t, g, unknown or other
  misc_feature (503)..(503): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgctatttttaaaggtgtccagtgtgaggtgcagctggtggagtcgtgggggaggcttggtccagcctggggggtccctgagactctcctgtgcagcctctggattcaccttcagtatttangctatgcacgtcgggtccgccgaggcctccgaaggggaacgggtccgtaggaatatgtctcgaggttataggaaagtatgacgaataacatatattanagacaaactctgagaaggcagtattcgacctatcctacgaggactaagttacccaaagtaccacgtctagtactcttaacaaagtcgggcacgtcctaggagagtcgaggtacgaccgacggtnttacgttatactttacggtgggtagggagtaagggacgtaacgggtaagttcgggtaaaccggttaggggttcggtacggggacgtacgggg

SEQ ID NO: 268199 - DNA, 607 bp, Homo sapiens
  misc_feature: GYAE6OF02HA78I.28.57.F02.1.454.CMB.1.raw
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (453)..(453): a, c, t, g, unknown or other
  misc_feature (453)..(453): n is a, c, g, or t
  modified_base (476)..(476): a, c, t, g, unknown or other
  misc_feature (476)..(476): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggcgtgagcgtgggttttccgttgttgctattttttaaaggtgtccagtgtgaggtgcagctggtggagtcgtggggggaggcttcggtccgagccgtcgggggggttccctgagactctcctgtgcagcctcgtggattccaccttcagttatttatgactatgcacgtcggggtcccgccgaggcctaccgaggggaagggacgtgaatatgttcngaggtattaagaagtaatgacgaataacataattatatcgactaaactntaggtgaagggctagtactcacatctaccgaggacacttaccaagaacncgtactcgttatacttactaagngggacacgaccgtgaagacgcgtgaacgggactacgggcttagtattacgttacgtagggtcgggaaggacggtaggacggttaaggttacggaacggtttagggggttcggtcggggaccggtaacgggg

SEQ ID NO: 268200 - DNA, 636 bp, Homo sapiens
  misc_feature: GYAE6OF02HK4JY.28.57.F02.1.454.CMB.1.raw
  modified_base (334)..(334): a, c, t, g, unknown or other
  misc_feature (334)..(334): n is a, c, g, or t
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagcccccgccctgggtttccaaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggcctccgaagggaacgggctgggaatatcggtntacgaggtattagaagtaatgacgaaataanatatattatgacaaactctagtagagggcagtatcaccatctcgaggactaattaccaagaacacgactagtactcttaacaaagtcgggacacggtaccttggaaccgtaggtaccgttacggaacgggtaaccgaccgggtaccttaggtaacgttttaagttaccggttaagggtagggggtaagggtaagggtacgggaacgggttaaggttcggggtaaaacggtttacggggggtttgggtacggggggtcccggtaacgggggg

SEQ ID NO: 268201 - DNA, 653 bp, Homo sapiens
  misc_feature: GYAE6OF02J2Y2W.28.57.F02.1.454.CMB.1.raw
  modified_base (366)..(366): a, c, t, g, unknown or other
  misc_feature (366)..(366): n is a, c, g, or t
  modified_base (556)..(556): a, c, t, g, unknown or other
  misc_feature (556)..(556): n is a, c, g, or t
  modified_base (577)..(577): a, c, t, g, unknown or other
  misc_feature (577)..(577): n is a, c, g, or t
  modified_base (591)..(591): a, c, t, g, unknown or other
  misc_feature (591)..(591): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagccgtgggggggtcccctgagactcctcctgtgcagcctctggattcaccttcagttatttactgcttatgcacgtgggtcccgccaggctccgaggggaacgggctagggaatagtgtctcgaggttattaagaagttaagngacgaaataacattaattatttatacgactaaaacttctaggtaggaagggctaagacttccaacctagtccctacggagggtaacctaacgttaccaaacgacctacggtcttagttacttccgttaacaaagtcggggactaagcccgtaggaacggcgtaccgtaggaaccggaacgaaccggggtnttagtattacgttttaccggngggtcggggaaagngggacggtaacggtaaggttacggaaaggttcgggtttagggtacggggaccggtaacgggg

SEQ ID NO: 268202 - DNA, 748 bp, Homo sapiens
  misc_feature: GYAE6OF02HKVQJ.28.57.F02.1.454.CMB.1.raw
  modified_base (348)..(348): a, c, t, g, unknown or other
  misc_feature (348)..(348): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgtcttaagtttttaaaggtgtccagtgtgaggtgcagcgtggtggagtcggtggggggaggtcgttgggtccaggtccggttcgggggggtccctggacgtactccgtccgtggtgcagccctgtggtacttcctacctttctaagttattttatcgtacttatgtaccgtacgttcggggtcccnccgtacggcctaccggaaggggaacgggactaggaatagtcgtctacgtaaggttaattaaggaaagttaagtcgtaacgtaaaataaactaagttaattaagtttaatacgtaacctaaaacttcgttaaggtacgggaaaagggtctaacggtacttacccaacctagttaccctaaccggaacgggtaaacctaaacgttaacccgaaaacggaaacctacgtacgttagtaacttaccttaacgtaaagtcgggactacgtaccgtagagtacgtcgtaggaacgacgacgtcgttacgttattacgttacggtagggtacgggaaggtaagggtaacggtaacggtaaggtacgggttaacggttagggggttcggtacggggaccgtaacgggg

SEQ ID NO: 268203 - DNA, 701 bp, Homo sapiens
  misc_feature: GYAE6OF02F3EXV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcacgcctctggattcaccttcagttatttatgctatgcactgggtccgccgaggctccgagggaacggacgtaggaatgtgtctcgaggttattagaagtaatgacgaataacatatattatgactaaactctagtaggagggacaggtacttacaacctatcctaccggaagggaacctaaacttacccgaaacgaaccacgcttacgttaacttaccgtttaacgaaaacggtgggaacctaacggtacccgtaggtaacggacggtaccgtagggaaaccggtaaccgacgggttactaggtttaacttaacgtttaaccggttggggtaagggggtaacgggtaaggggtaacgggtaacggggttaaacggttttaacgggggtaaaaccgggtttagggggggttttacggggtaccgggggggtacccgtaaaccgggggggg

SEQ ID NO: 268204 - DNA, 563 bp, Homo sapiens
  misc_feature: GYAE6OF02G3596.28.57.F02.1.454.CMB.1.raw
  modified_base (303)..(303): a, c, t, g, unknown or other
  misc_feature (303)..(303): n is a, c, g, or t
  modified_base (411)..(411): a, c, t, g, unknown or other
  misc_feature (411)..(411): n is a, c, g, or t
  modified_base (480)..(480): a, c, t, g, unknown or other
  misc_feature (480)..(480): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggggttttccttgttgctatttttaaaggtgtccagtgtgaggtgcagctggtggagtcgtgggggaggcttggtccagccgtggggggtccctggagactctcctgtgcagcctctggattcaccttcagttatttatgctatgcacgtgggtccncgaggcctccgaggggaagggactaggaatatgtctcaggttattaggaagtatgacgaataacatatattatgacaaactctagtaggaagggcagattcacatccncgaggacaataccaagacacgctgtactcttacaaagtgggacaggcctagagagctggagacgacggntagtatagttacgtggtagggaagtagggagtacgggtaagttcggggtaacgttaggggttggtacgggggaccaacggggg

SEQ ID NO: 268205 - DNA, 693 bp, Homo sapiens
  misc_feature: GYAE6OF02H5T0M.28.57.F02.1.454.CMB.1.raw
  modified_base (290)..(290): a, c, t, g, unknown or other
  misc_feature (290)..(290): n is a, c, g, or t
  modified_base (617)..(617): a, c, t, g, unknown or other
  misc_feature (617)..(617): n is a, c, g, or t
  modified_base (633)..(633): a, c, t, g, unknown or other
  misc_feature (633)..(633): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggtcgttggtccagccgtggggggtccctggagactctcctgtgcagcctcgtggattccacctttcagttatttangctatgcacgtcgggtccgccgaggtcctaccggaggggaacgggtacgtaggaagttacgtgtacctaccgtaaggttaacgttaaggtaaaggttaaagtcggaacggtaaaacttaaaccaatttaagttaatttaacgttcggaacctaaaaccgttcttagggtacggtaaacggggtacctaagggtactttaacccaaccgtaacttccgtacccgagggtaaacctaagttacccaaaggtaacccaccggttcttacgtaacttccgttaagaaagttcgggctacgtccgtagacgaggtcctaggacgacacggtnttagtatacgttacgnggtaacgggagaaggcgaggtacgttaggaacggttggggtagtccggggataacggggg

SEQ ID NO: 268206 - DNA, 607 bp, Homo sapiens
  misc_feature: GYAE6OF02GCEJJ.28.57.F02.1.454.CMB.1.raw
  modified_base (381)..(381): a, c, t, g, unknown or other
  misc_feature (381)..(381): n is a, c, g, or t
  modified_base (437)..(437): a, c, t, g, unknown or other
  misc_feature (437)..(437): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcgttggtccagccgtggggggtccctggagactctcctgtgcagcctctggattcaccttcagttatttatgctatgcacgtgggtcccgccaggcctccgaggggaagggacgtggaatatgtctcgaaggtattaaggaagtaatgacgaaataactatatattangacaaactctagtagaagggcagattcacatctcgaggaactactacaagacacgntagtacttctacaagtgggacacgtaccgtaggacgagtcgtacggtacggaaccgacggtcgttaaggtacttagtttacgtagggtaggggaacggaaggggtagtacgggtaaggttacgggtaaaccggttagggggtttacgggtacgggggaccgtaacggggg

SEQ ID NO: 268207 - DNA, 694 bp, Homo sapiens
  misc_feature: GYAE6OF02IF3NN.28.57.F02.1.454.CMB.1.raw
  modified_base (289)..(289): a, c, t, g, unknown or other
  misc_feature (289)..(289): n is a, c, g, or t
  modified_base (378)..(379): a, c, t, g, unknown or other
  misc_feature (378)..(379): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccagccgtggggggtccctggacgactctcctgtgcagcctctggattccacctttcagttatttangctatgctacgtgggtccgccaggcctccgaggggaaggctaggaatatgtcacgaggtattagaagtatgacgaataacatatattannactaaactctgtagaggcagtattaccacctataccgtaccgacgggtaactaacgttaccgaaacggaaacctaccggtctttacgtaactttacccgtttaacgaaaacgttcggggacctacgtacccggtaggaacgtacgtcgtacgggtaaccgggaaaccgtcgggtacgtacgtttaacttaaccgttttacgggtgggttaacggggaacgggtaagggtacgggtaaacccgggttaaggtttacggggtaaacgggttttacggggggtagggttacccgggggggtaaccggtaaccgggggg

SEQ ID NO: 268208 - DNA, 612 bp, Homo sapiens
  misc_feature: GYAE6OF02H1XNW.28.57.F02.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccacctttcagttatttangctatgcacgtgggtccnccaggcctccgagggacgggactgggaatagtgtctcgtaggtattaggaagtaatgacgaataacgatataattatcgactaaactctaggtagaagggacagtacttacactatctacgaggtacaactaccgaagaacacgtactatacttactagaaacgtggacacgacctagacgtagacgtaggacggaacgacggtactagttagtaagtttcggtaggtacggggaggaagggtacggagggttaacggttaggggtaaccggttagggggtttcgggtaccgggggaccgtaacggggg

SEQ ID NO: 268209 - DNA, 633 bp, Homo sapiens
  misc_feature: GYAE6OF02F63LR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctcctgtgcagcctctggattcaccttcagttatttatgctatgcacgtgggtccgccaggctccgaggggaacggactggaatatgtctacgaggttattagaagtaatgacgaataaacattaattattagtagaactaaacttcgtagtaggaacgggctaaggtatttacccaacctagttccctaccggaagggtaactaaacgttacccaaagaaccacgtactagttaactccttaacgaaagtcgggacaggaccctggaacgagcgtagggaacgaccgacgggtacttagttacttagttacggttgggtaggggagtaagggagtacggtaagttacgggtaaacgttaggggttcggtagggaccggtaacgggg

SEQ ID NO: 268210 - DNA, 592 bp, Homo sapiens
  misc_feature: GYAE6OF02IVZOF.28.57.F02.1.454.CMB.1.raw
  modified_base (343)..(343): a, c, t, g, unknown or other
  misc_feature (343)..(343): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (376)..(376): a, c, t, g, unknown or other
  misc_feature (376)..(376): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggtttcccaggtgttctcattggttgatcagcactgcacacagaagagtcatgacggagtttgggcgtgagctgggttttccgtttgtttgctatttttaaaggttagtccagtgtgaggtgcagctggtggagtctgggggaggcttggtccagcctggggggtcccgtcgagactctcctgtgcagcctctggattcaccttcagttatttatgctatgcactgggtccgccagggctccgaggggaagggactggaatatggtctnaggtattagaanatgacaataacntatattatnacaaatctgtgaacgggcagtattcacatctccgagggacaattaccaaacgaacacgtagtcttagttcttacaaagtgggcagtcctagganagtctaggacggctaaacgggctacggttaattagtttaaccgtggttacgggaggtaagggacgtacgggtaacgtttaggggtaacctaagggggtttcgtagggggccctaacgggggg

SEQ ID NO: 268211 - DNA, 575 bp, Homo sapiens
  misc_feature: GYAE6OF02F0D00.28.57.F02.1.454.CMB.1.raw
  modified_base (488)..(488): a, c, t, g, unknown or other
  misc_feature (488)..(488): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccccgagactctcctgtgcagcctctggattcaccttcagttatttatgctatgcacgtcgggtccgccgaggcctccgaggggagggactaggaatagtgtctacgaggtattagaagtaatgacgtaatacatatattatgactaaactctagtagaagggcagtatcactatcacgaggactaacttccaaagaccacgtctagtactcttacaagtggacacgtcctagagagcgtagacgacgacggtntagtatattacggtggtagggagagggtaggtacggtaagttagggaacggttaggggtttgggacggggtaccgtaggggtacccg

SEQ ID NO: 268212 - DNA, 713 bp, Homo sapiens
  misc_feature: GYAE6OF02IOH5E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtctggggggaggcttggtccagccgtggggggtccctgagactctcctgtgcagcctctggattccacctttcagttatttatgctatgcactggggtcccgccagggcctaccggagggggaacgggacgtaggaatagttgtcttacgtaaggttaattaaggtaaagttaagtcggaacgtaaaactaaactattaattaattatacggaacctaaactcgtaggtaggtaagggactaagtacgttaccaacctattccgtaccggaaggggtaaccctaaacgttacccgaaaacgtaaaccgaccggtacttacgttaactttaccttaacgaaaacggtcgggaactacgtaccgtaggacgtacgcggttaagaacgggaaccgtacgggtacttacgttattaacgtttacgggtagggtacgggaggtaacgggtaagggtacggttaaggttacggggtaaggttaagggggttcgggtacggggtacggtaaccgggg

SEQ ID NO: 268213 - DNA, 664 bp, Homo sapiens
  misc_feature: GYAE6OF02GWWSO.28.57.F02.1.454.CMB.1.raw
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttattttatgctatgctacgtgggtcccnccgaggcctccgaaggggaacggactaggaatatgtctcgaggttataagaagtaatgacgtaataacataatattancgaactaaactctgtaggaacggcagtacttacgacctagtccctacgaagggtaactaacttacccaaagtaaaccacgggtacttacgttaacttccgtttaaacaaaaggttcgggacctaacggccgttaggaagtacggtacttaggggaaacgaacgtaccgggtattacgttaattacgtttacggtgggttaaggggagtacggggaacggtacgtaagggtttcggtaaaaccgggtttgggggtttccggacgggggtacccgaacgggggg

SEQ ID NO: 268214 - DNA, 554 bp, Homo sapiens
  misc_feature: GYAE6OF02I4S16.28.57.F02.1.454.CMB.1.raw
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctggagactctcctgtgcagcctctggattcaccttcagtattttangctatgcacgtgggtccncaggctccgagggaggctggatangtctnaggtataggaatangacgaataacntatatatgactaactctggtagagggcagtattcactatccacgaggacaattccaagacngactgtatctacaagtgggacagccgtagacgagtccgtaggaacgacgaacggtctagttactattacgtgggtacgggaggaacggaggtacgtagttacgggaacgttggggttggacggggccgtaacgggg

SEQ ID NO: 268215 - DNA, 746 bp, Homo sapiens
  misc_feature: GYAE6OF02ITYB2.28.57.F02.1.454.CMB.1.raw
  modified_base (323)..(323): a, c, t, g, unknown or other
  misc_feature (323)..(323): n is a, c, g, or t
tcagagtacgctatcacgaccggtgctcgatttagctcgatatagttgggtctgggagaggacgccccccgcccctgggtttcccaggtgttctcatttggtgatcagcactgcacacagaagagtcatgacggtagtttgggctgagcgttgggttttccttgttgcttaatttttaaaggtgtccagtgtgaggtgtagctggtggagtcgtgggggaggtcttggtccgagccgtcggggggtccctgagactctccgtgtgcacgcctcgtggacttccaccttcagttatttagtgactatgctacgtcggggtcccnccgaggcctaccggaaggggaaggacgtaggaatagtgtcttcgaaggttaataagtaagtaagtgaacgaaataactaattaattaatttatacgtaactaaacttacgtagtaaggaaacggctaaggttaacttacccgaacctagtcccgtaacccggaacggaaaccttaacgttaaccaaaacgtaaacctaacggttaccttaggtttaaccttaccgtttaaaccgtaaagggtcggaaccctagtaccgtaaggtaacgtacgtaccgtaggaacggtaaccgtacggttactagttaacgttaacgtttcggtaggggtaaggggaaggacggggtaacgggtacggttaaaggtttaacgggtaacgggtttaacgggggttcgggacgggggtaccgtaggggtaccccgg

SEQ ID NO: 268216 - DNA, 644 bp, Homo sapiens
  misc_feature: GYAE6OF02IC0P8.28.57.F02.1.454.CMB.1.raw
  modified_base (496)..(496): a, c, t, g, unknown or other
  misc_feature (496)..(496): n is a, c, g, or t
  modified_base (566)..(566): a, c, t, g, unknown or other
  misc_feature (566)..(566): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctggagactctcctgtgcagcctctggattccacctttcagttattttatgcttagtgcacgttcgggtccgcccgaggccttacccgaagggggaagggacctgggaatgtgtctagaggttattaaggaagtaatggacgaaataacattaatattatagactaaactctaggtacgaagggcaagtattaccacctactctaccgaaggactaacgttaccaaagaaccaccggtcttcggttaactcctttaanaaagtcgggacacgggcctaggacgaggccgtaggaacggcaacgggtctaggttacttaacgtttacgngggttacgggaaggtagggaacgtacgggtaagttacggggaacgttagggggtttgggtacggggccggtaacgggg

SEQ ID NO: 268217 - DNA, 615 bp, Homo sapiens
  misc_feature: GYAE6OF02GIKOC.28.57.F02.1.454.CMB.1.raw
  modified_base (334)..(334): a, c, t, g, unknown or other
  misc_feature (334)..(334): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatgcacgtgggtcccgccaggcctccgagggaagggactggaattntgtctcgaaggttattaagaagtaatgacgaataacataatattatgactaaactctaggtacggaagggcaagtattaccaactactccgtaccgaagggaactaacgttaccgaaagaaccgaaccgtcgttacgtaacttaccttaacgaaacgttgggactacgtcccgtagacgacgtcgtaggaacggacacgggactagtacttacttacgtgggtaggaaggtaggaggtacgtaagttgggaacggttgggtcggtacggggcgtaacgggg

SEQ ID NO: 268218 - DNA, 589 bp, Homo sapiens
  misc_feature: GYAE6OF02J14AH.28.57.F02.1.454.CMB.1.raw
  modified_base (273)..(273): a, c, t, g, unknown or other
  misc_feature (273)..(273): n is a, c, g, or t
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
tcagagtacgctatcacgaccggtgctcgatttagctcgatatagttgggtcgtgggagaggagcccccgccctcgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggattcaccttnagttatttatgcttatgctacgtgggtcccgccgaggctccgagggaagggtactggaaattctggtctacgaggttaattaagaacgtaatgtcgaaatacatatacttangacaactctaggtagagggcagatacacactctaccgaggacacttacaagaacacgctgtatcttanaagtcggnacgctagagacgcgtagacgacgacgggtcttagtattaacttacggtggtacggggtagaagggtacggtacgggtaactttacgggaaacgggtttgggtacggggtcgggtacccggtaaggggg

SEQ ID NO: 268219 - DNA, 612 bp, Homo sapiens
  misc_feature: GYAE6OF02IV5KX.28.57.F02.1.454.CMB.1.raw
  modified_base (285)..(285): a, c, t, g, unknown or other
  misc_feature (285)..(285): n is a, c, g, or t
  modified_base (385)..(386): a, c, t, g, unknown or other
  misc_feature (385)..(386): n is a, c, g, or t
tcagagtacgctatcacgaccggtgctcgatttagctcgatatagttgggtctgggagaggagcccccgccctgggtttcccaggtgttctcatttggtgatcagcattgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttattttacngcctatgcacgtcggggtccgccgagggcctaccgaggggaagggctagggaatactgtctcgaggtattaagaagtaagtgacgaataacatatattannactaaactcgtgtaggaagggtcaagtacttaccaacgattaccctacggaagggactaaacttaccgaaagaacctacgcttagtacttacttaaccaaagtcgggactaacgccgtagagacgtcgtaggacggacaggacttgtaatagtttacgtgggtacgggaagacggaggtacggtaattagggtaaccgttagggtcgggtacgggacgtacggggg

SEQ ID NO: 268220 - DNA, 573 bp, Homo sapiens
  misc_feature: GYAE6OF02G0JKT.28.57.F02.1.454.CMB.1.raw
  modified_base (487)..(487): a, c, t, g, unknown or other
  misc_feature (487)..(487): n is a, c, g, or t
  modified_base (504)..(504): a, c, t, g, unknown or other
  misc_feature (504)..(504): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagttatttatgctatgcacgtgggtcccgccaggcctccgaggggaagggacgtggaatatgtctcgaggtattagaagtaatgacgaataacatatattatagactaaactctgtaggaagggcaagattaccacctaatcctaccgaagggacaattacccaaagaaccgacgtcgtagttacttacttacaagtggacagccgtagacgngcgtagacggacacggntagtatattacgtggtaggagtaggagaggtaagttaggaacgttaggggttggtcggggacgtacggg

SEQ ID NO: 268221 - DNA, 551 bp, Homo sapiens
  misc_feature: GYAE6OF02IZ97H.28.57.F02.1.454.CMB.1.raw
  modified_base (283)..(283): a, c, t, g, unknown or other
  misc_feature (283)..(283): n is a, c, g, or t
  modified_base (371)..(371): a, c, t, g, unknown or other
  misc_feature (371)..(371): n is a, c, g, or t
  modified_base (465)..(465): a, c, t, g, unknown or other
  misc_feature (465)..(465): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttangctatgcactgggtcccgccaggcctccgaggggaagggctaggaatatgtctcaggtattagaagtatgacgaataacatatattangactaactctgtaggaagggcagatcaacctatccgtacgagggacaacttaccaaagaaccacgactgtattctacaaatgggcagcctgagngctgagaccagctgtatattacgtggtaggagaggaggaggtaacgttgggaacgttaggggtttcggtacggggactaacggggg

SEQ ID NO: 268222 - DNA, 608 bp, Homo sapiens
  misc_feature: GYAE6OF02F1DJZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggacttcaccttcagtatttatgctatgcacgtgggtccgccgaggcctccgaaggggaacgggactggaatatgtctcgaggtattagaagtaatgacgaataacatatattatagacaaactctaggtaggaagggacagtattaccacctatcctaccgagggaactaacttacccgaaacgaacaccgtctagttaactccttaacaaagtgggacagcctaggacgacgcgtaggacgacgacggtcttagtatacgttacgtagggtagggaacggtagggacggtacggtaagttacgggtaaacggtttggggtagggtacgggggacccgtaacggggg

SEQ ID NO: 268223 - DNA, 721 bp, Homo sapiens
  misc_feature: GYAE6OF02HYC6K.28.57.F02.1.454.CMB.1.raw
  modified_base (641)..(641): a, c, t, g, unknown or other
  misc_feature (641)..(641): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggagtcgttggtccaggtccgtcggggggtccctggaagccttctcctgtgcgagcctcgtggattccacccttcagttattttagtgtcttagtcgactacggttcgggtcccgccgtagggcctaccggaaggggaaggggaccttaggtaacgttattcggtaccgttaccgaagggttaattaaggaacgttaagtgaacgtaaataactaattaagtaatttatacgaacctaaacttcgtaggtaggaaacgggcagtacttcccaacacgttcgtacccgaagggaacctaaacgtaccgaacgaaaccgtacgtcttagttaaccttacgttaaccaaaggtcgggtaccacggttaccgaggtaacgagttaccgagggtaaaccggaccgtacggttacgttagtttaattacgttacggngggttacgggaaggaggtacgggaacggttaagggttaggtaaaccgggtttaggggtacggtggggaccgtaacggggg

SEQ ID NO: 268224 - DNA, 760 bp, Homo sapiens
  misc_feature: GYAE6OF02INGSI.28.57.F02.1.454.CMB.1.raw
  modified_base (318)..(318): a, c, t, g, unknown or other
  misc_feature (318)..(318): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcgttggtccaggccgtggggggtccctgagacctctccgtgtgcagcctctggtacttccaccttcagttatttatgtactatcgctaccgttcggggtcccnccgacgggtcctaccggaagggggtaacgggaccgtaagggaacttagtcgtctacgtaaggttaattaaggtaaagtaagtagaacgtaaataaacgtattaagttaattacgtgaaccttaaaacttcgtaggtaacggaacgggtactaggtaactttacccgaacctaacgttccctacccggaaagggtaaacctaaaccgtttaacccaaaacggaaacctaccggttacttaacgtttaacgttaaccttaacgaaaacggtcgggaccgtaagtacccgttaggaggtaacgtcgtacggggaacggaaccgtaaccgggtacttaaggttaactttaaggttacggttgggtaacggggaaggtacgggacgggtaacggttaaggttaacgggtaacgggttaggggttcgggtacgggggacctacggggg

SEQ ID NO: 268225 - DNA, 699 bp, Homo sapiens
  misc_feature: GYAE6OF02IS0FQ.28.57.F02.1.454.CMB.1.raw
  modified_base (518)..(518): a, c, t, g, unknown or other
  misc_feature (518)..(518): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtcagccgtggggggtccctgagctctcctgtcgcagcctctggattcaccttcgagttatttatgctagtgctacgtcgggtcccgcgaggccgtacgaggggaacgggacgtagggaatatcgtctacgtaggtaattagaagtaatgaacgaaataacattaattattagtcgaactaaactcgtagtagggacgggactagtacttaccactataccctaacccggtagggtaaacctaacttaaccggaaaaccgtaaccgtaacggtcttaagttaccttaccgttaacgtaagngggacctacgaccgtagtaaccgagtcggtaacggaacgggaccggtaacggtacgtagtttacttacggtttaacggtggggttaaggggaacgggtaagggtacggggtaacggttaaagggttacggggtaaaccgggtttaggggttacggggtaccgggggacggtaaccgggggg

SEQ ID NO: 268226 - DNA, 704 bp, Homo sapiens
  misc_feature: GYAE6OF02IH16A.28.57.F02.1.454.CMB.1.raw
  modified_base (283)..(283): a, c, t, g, unknown or other
  misc_feature (283)..(283): n is a, c, g, or t
  modified_base (625)..(625): a, c, t, g, unknown or other
  misc_feature (625)..(625): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctattttaaaggtgtccagtgtgaggtgcagctggtggagtcgtgggggaggcttggtccagccgtggggggtccctgagactctcctgtcgcagcctctggattcacttcagtattttangtctatcgcacgtcggggtcccacgaggtcctccgaaggggaacggctaggaattagtcgtccgtagtaggttaattaaggaaacgttaaagtggaacgtaaaataaacgattaagttaattagtacgtaactaaaacttcgtaggtaaggaacggggtaactagtaacttaccaactagtaccctaccggaaagggtaaacctaaacgttaacccgaaaacgaaaccgtaacgaccttagttaacctttacgttaaacctaaagtaccgggactaaccgccgttaggaacgacgacgttaggaacgggtaacgaccggtcgttagtacttacgtttaacgngggtacgggaaggtaaggacggtaggtaacgttacgggtaaggtttaacggggtcgggtacggggtaccgtaacggggg

SEQ ID NO: 268227 - DNA, 545 bp, Homo sapiens
  misc_feature: GYAE6OF02GWYB0.28.57.F02.1.454.CMB.1.raw
  modified_base (366)..(366): a, c, t, g, unknown or other
  misc_feature (366)..(366): n is a, c, g, or t
  modified_base (459)..(459): a, c, t, g, unknown or other
  misc_feature (459)..(459): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgaggggaagggactggaatatgtctcaggtatagaagtaatgacgaataacatatattangacaaactctgtagaaggtacagattcacctaatctaccagggacaattccaaagaacacgctatattctacaatcgggacagcctagagagntggaggacacggctagtatattagtggtaggagaggtagacgggtaattagggtaacgtaggggtttggtacggggcgtaacgggg

SEQ ID NO: 268228 - DNA, 735 bp, Homo sapiens
  misc_feature: GYAE6OF02IQMB6.28.57.F02.1.454.CMB.1.raw
  modified_base (328)..(328): a, c, t, g, unknown or other
  misc_feature (328)..(328): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgcttatttttaaaggtgtccagtgtgaggtgcagctggtggagtcgtgggggaggcttggtccagccgtggggggtccctgagactctcctgtgcagcctctggattcaccttcagttatttatgctatgcactgggtccgccaggctccgagggaggactggaatntgtctcgaaggtattagaagtaagtgacgaaataaacattaatatttatgactaaacttctaggtagaagggcaagtattccaacctatcctaccgaagggtaacctaaacttacccgaaaagaaaccaccggtacttacgttaacttccctttaacgaaaaacgttcgggggaactaacggtacccgtagggaacgacggtaccgtagggtaaacggggaacccgtaaacggggtaccttacggtttaactttaacggttttaaccggttagggggttaaacggggggtaagggtaaaccgggggtaaggtaacccgggggttaaagggttttaaccggggttaaaacccgggtttaagggggggtttacggggttacgggggggtaacccggtaaacgggggggg

SEQ ID NO: 268229 - DNA, 580 bp, Homo sapiens
  misc_feature: GYAE6OF02HG1B8.28.57.F02.1.454.CMB.1.raw
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgccactgggtccgccagggcctccgaggggaagggactgggaatagtgtctcaggtatagaagtatgagaataacatatattatnactaaactctgagaagggcagtatcacatcaccgagggactaagttaccaaagaaccacgtacgtgtacttcttacaaacgtgggactacgcctagaagacgtcgtacggaacggaccacgggcttaggtattacgttacgtggtagggagtagggacggtaggtaagttaggaacgttaggggtcggtacggggaccgtaacgggg

SEQ ID NO: 268230 - DNA, 581 bp, Homo sapiens
  misc_feature: GYAE6OF02F14ON.28.57.F02.1.454.CMB.1.raw
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagccgtggggggtccctgagactctcctgtgcagcctcgtggattcaccttcagttatttatgctatgcacgtgggtcccgccaggcctccgaggggaagggactggaatatgtctcgaggtatagaagtatgacgaataacatatattatgacaactctagtaggagganagtattcacatcctaccgaaggactaacttccgaaagtaaccacgtctagttactactactaaagtcgggacacgctggagaggctaggaacggacgacggtcttagttactagttacgtgggtagggtagagggtacggacggtagttcgggtaaaccgttggggtagggtcggggacgtacgggg

SEQ ID NO: 268231 - DNA, 563 bp, Homo sapiens
  misc_feature: GYAE6OF02FL6L9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcactgggtccgccaggctccgaggggaaggactgggaatatgtctcaggtattagagtaatgacgaataacatatattatgacaaacttctgtagaagggcagtacttcacatcctaccgagggacaacttaccaagaccacgctagtactcttcaaatgggacacgcctagagtagcgtagacggacacggctacgtattagttacgtggtacgggaggaggaggacggtaagttaggtaaccggttagggttagggtacggggacgtaacgggg

SEQ ID NO: 268232 - DNA, 594 bp, Homo sapiens
  misc_feature: GYAE6OF02GOLIC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagtatttatgctatgcacgtgggtccgccaggctccgaggggaagggactggaatagtgtctcgaggttattaagaagtatgacgaataacatatattatgactaaactctagtaggaagggcagtattcaacctatcctaccgaaggaactaaacgttaccaaacgaacacgactagttactcttacaagtgggcacggccgtagagacgctaggacggacacggctagtattagttacgtgggtagggaaggagggaggtacggtaaggttacgggtaaacggtttggggttacgggtacgggggaccgtaacggggg

SEQ ID NO: 268233 - DNA, 561 bp, Homo sapiens
  misc_feature: GYAE6OF02HY8B9.28.57.F02.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttangctatgcacgtgggtccnccaggctccgagggaaggggactaggaatatgtctcgaggtattagaagtaatgacgtaataacatatattatagacaaactntagtagaggcagatcacatctcaggacaactacaagacacgtctagtatcttacaaagtcgggacacgctagagagcctggaacggacacggtctagttatagttacgtggtgggaagagggtaggacgggtaagttacgggtaacgttagggggtaggttacggggcccgtaaggggg

SEQ ID NO: 268234 - DNA, 560 bp, Homo sapiens
  misc_feature: GYAE6OF02JZV9C.28.57.F02.1.454.CMB.1.raw
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (280)..(280): a, c, t, g, unknown or other
  misc_feature (280)..(280): n is a, c, g, or t
  modified_base (299)..(299): a, c, t, g, unknown or other
  misc_feature (299)..(299): n is a, c, g, or t
  modified_base (381)..(381): a, c, t, g, unknown or other
  misc_feature (381)..(381): n is a, c, g, or t
  modified_base (487)..(487): a, c, t, g, unknown or other
  misc_feature (487)..(487): n is a, c, g, or t
tcagagtacgctatcacgaccggtgctcgatttagctcgatatagttgggtctgggagaggagcccccgccctgggtttcccaggtgttctcatttggtgagtcagcactgcacacagaagagtcatgacggagtttgggctgagctgggttttccttgttgctattttaaaggtgtccagtgtgaggtgcagctggtgagtctgggggagcttggtccaggcctggggggtccctgagactctctgtgacagcctctaggnttcaccttnagtatttangctaatgcacgtgggtccnccaggctccgagggaaggactggaatatgtctcaggtatagaagttaagtacgaataacgatagtattacgtgactaaactntgtagaagggcagtaattcaccatctccgagggactaattcgaaacgaacacgcgttagcttacttacaaagtcgggactagcctagacgagcctagagtcgacgntgtatagttacgtggaggtacgaaggtgtacggtaacgttggaaaccgttgggtggaccggggactaacgggg

SEQ ID NO: 268235 - DNA, 760 bp, Homo sapiens
  misc_feature: GYAE6OF02HCWED.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcctgttgctattttaaaggtgtccagtgtgaggtgcagctggtggagtcgtgggggaggcttggtccagccgtggggggtccctgagactctcctgtgcagcctctggattccaccttcagttatttatgctatgcacgtcgggtcccgccgtaggcctaccgaagggggaacgggacgtagggaattagtgtactacgaaggttattagaagtatgacgaaataacatataattatagactaaacctgtagtaggaacgggtacaagtacttccgaacctattccgtaccggaaagggtaacctaaacgttaccgaaacgtaaaccgaaccgtacttacggttaactacccgtttaagtaaaacggtcggggaacctacgggtacccgttagggaaacgacggtaccgtaagggtaaaccgggaaccgtaaccgggggttacttaaccggttttaagtttaaaccggtttaccgggttgggggttaacggggaaacggggttaaagggaccggggtttaaacgggtaaggttttaacccgggggtaaacgggttttaccgggggggtttaacggggtacccgggggggtacccggtaaccggggggg

SEQ ID NO: 268236 - DNA, 566 bp, Homo sapiens
  misc_feature: GYAE6OF02IAJYR.28.57.F02.1.454.CMB.1.raw
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (470)..(470): a, c, t, g, unknown or other
  misc_feature (470)..(470): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattccaccttcagtatttatgctatgcacgtcgggtccnccgaggcctccgaaggggaaggactggaatatgtctcgaggtattagaagtaatgacgaataacatatattangacaaactctagtagaagggcagattcacctatcacgaggactaactaccaagacacgctagtatcttacaaagtcggacacgtccgtagacgngtcgtaggacggacggcgtactagtacttattacggtggtagggagagggtagacggtagttacgggacggttaggggtgtacggggctaacgggg

SEQ ID NO: 268237 - DNA, 745 bp, Homo sapiens
  misc_feature: GYAE6OF02IJO8E.28.57.F02.1.454.CMB.1.raw
  modified_base (264)..(264): a, c, t, g, unknown or other
  misc_feature (264)..(264): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggtcttggtccagccgttggggggtcccctgagactctcctgtgcagcctntggattccaccttcagttatttatgcttatcgctacgttcggggttcccgccgagggccttaccggagggggaaacgggtccgtaggaatatgtactcgaaggttattaagaacgtaatacggacgtaaattaaacgaataattaatttagtcgtaactaaaaccttcgtagtagggaacgggtcgaacgtatttaccaacccgaagttccctaacccggtacgggaacttaaaccgtaccaaaaggtaccaacgtaccttggtaacttctttaccaaagtcgggtacaacggtcccgttgaagacgtaccgttagggaaccgggaacgtaccgggtactttaacggttaacgttacgtttaaaccggttgggggaacgggggttaacgggtaagggggaacggtaacggggttaacgtttagggggtaaacccgggtttaggggggtttcgggttacccgggggggccgtaaccgggggg

SEQ ID NO: 268238 - DNA, 604 bp, Homo sapiens
  misc_feature: GYAE6OF02H89CC.28.57.F02.1.454.CMB.1.raw
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctggagactctcctgtgcagccctctggattccaccttcagttattttatgcttatgcacgttgggtcccgccgagggctcccgaaggggaaggggactgggaatatgttcnctaggtattaagaaggtatgacgaaataacatatattanacgcaaattctgtaggaagggcagacttcaccatcacagggacaatacgaataacactcctagtacttcctactaagtgggacagccgtagacgagctaggacgacgacggctagtagttcgttaacgtgggttaacgggagggtaagggaaggtaccgggtaagtttacggggtaaacggttaggggtttacgggttacggggggccgtaacggggg

SEQ ID NO: 268239 - DNA, 685 bp, Homo sapiens
  misc_feature: GYAE6OF02JRY28.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtccctgagactctcctgtgcagcctcgtggtattcaccttcagttatttagtgtctatgactacgtcgggtccnccgaggtctccgaagggaagggtactaggaatgttgtctacgtaaggttattaaggaagttaagtagacggtaaataacattaagttaattaatcgaactaaacttcttaggtaggaacgggtacaggtaactccgaacctataccgtaccgaaggtaacctaaacgttaccaaagaaccgacgtaccttaagtaacttccttaaacgaaacgtttacgggctaacggaccgttggaaacgtcggccgtaacggaacgaccgtaagttaccgttaggtattacgtttaacgggtaggtaggggaagaggggtaacgtaacggtacggttaagggtaacgggtttaggggttacgggtacgggggaccgtaaccggggg

SEQ ID NO: 268240 - DNA, 607 bp, Homo sapiens
  misc_feature: GYAE6OF02ITRKM.28.57.F02.1.454.CMB.1.raw
  modified_base (287)..(287): a, c, t, g, unknown or other
  misc_feature (287)..(287): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (442)..(442): a, c, t, g, unknown or other
  misc_feature (442)..(442): n is a, c, g, or t
  modified_base (455)..(455): a, c, t, g, unknown or other
  misc_feature (455)..(455): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtctggggggaggcttgggtccagccgtgggggggtccctgagactctcctgtgcagcctctggattccaccttcagttattttngtctatgcacgtgggtccgccaggcctccgaggggaacgggactaggaatatgtctcgaggtattaagaagtaangacgaaataacatatattancgacaaactntgtaggaggacagacttcactatctacgaggactaataccaaagacacgntagtactcttaanaaagtcggacagtacctaggaagacgtacgtagggaacggactacgggtacttagtaactttagttacgtgggtaggggaagaagggtacggaacgggttagttaggggtaaaccggttaggggttgggtaccgggggaccgtaacgggggg

SEQ ID NO: 268241 - DNA, 554 bp, Homo sapiens
  misc_feature: GYAE6OF02GV605.28.57.F02.1.454.CMB.1.raw
  modified_base (376)..(377): a, c, t, g, unknown or other
  misc_feature (376)..(377): n is a, c, g, or t
  modified_base (401)..(401): a, c, t, g, unknown or other
  misc_feature (401)..(401): n is a, c, g, or t
  modified_base (488)..(488): a, c, t, g, unknown or other
  misc_feature (488)..(488): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttattatgctatgcacgtgggtcccgccgaggtcctccgaggggaagggactgggaatagtgtctcgaggtattaggaagtatgacgaatacatatattannacaactctgtgaggcagattcacntctcgaggacaattacaagacacgctacgtatcttacgaatgggacagctgagagcgtagacggacgacggtctagtatagttacgnggtagggaggacggaggtacggaagttcgggaacggttaggggttggtacgggggactaacggggg

SEQ ID NO: 268242 - DNA, 551 bp, Homo sapiens
  misc_feature: GYAE6OF02GQJ6G.28.57.F02.1.454.CMB.1.raw
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (458)..(458): a, c, t, g, unknown or other
  misc_feature (458)..(458): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccgccaggctccgaggggaagggactgggaatagtgtctcgaggtattaagaagtaatgacgaaataacatatattatgacaaactctgtagagggcagattcacatcncaggacaattaccaanaacacgctagttatcttacaatgggacagcctagagancgtagaggaccgtacgcttaggtatagttacggtggtagggagaggagacggtaagttcgggaacgttaggggttggtaggggcctaacgggg

SEQ ID NO: 268243 - DNA, 552 bp, Homo sapiens
  misc_feature: GYAE6OF02H98LB.28.57.F02.1.454.CMB.1.raw
  modified_base (377)..(377): a, c, t, g, unknown or other
  misc_feature (377)..(377): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgcttatttttaaaggtgtccagtgtgaggtgcagctggtggagtcgtgggggaggcttggtccagcctggggggtccctgagactctcctgtgcagcctctggattcaccttcagttatttatgctatgcacgtgggtccgccgaggctccgagggaagggactgggaatatgtctcgaggttattagaattaatgacgaaataaacatatattangacaaactctgtagaaggcagatcaccatctacaggacaatccaaagacacgctagtatcttcaatgggacagccgtagagacgacgtcgaggacgacggcgtagttatattacgtggtggaggaggaggacggtagttagggaacgttagggtaggtagggggtacgaacgggg

SEQ ID NO: 268244 - DNA, 539 bp, Homo sapiens
  misc_feature: GYAE6OF02GETDT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcacgtggtccgccaggctccgagggaaggctggaatatgtctcaggtattagaagtatgacgaataacatatattatgacaaactctagtgaagggcagattcacatctcagggacaattaccaagtaacacgctgtactcttacaatcgggacagcctgagagcgtagaggacgacggcttaggtattagttacgtggtgggagaggaggacggtaagttggaacgtagggtttggtacggggcgtaacgggg

SEQ ID NO: 268245 - DNA, 560 bp, Homo sapiens
  misc_feature: GYAE6OF02HOAC3.28.57.F02.1.454.CMB.1.raw
  modified_base (419)..(419): a, c, t, g, unknown or other
  misc_feature (419)..(419): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcacctttcagtatttatgctatgcacgtgggtccgccaggcctccgagggaagggactggaatatgtctcaggtattagaagtatgcgaataacatatattatgactaaactctgtagaagggcagattcacatctcgaggacaattccaanaacacgctatacttctacaagtgggacacgctagagagcgtaggacggtacgacggtcttagtagttacttacgtagggtgggaggtaaggaggacggaagttacgggaagttaggggttggttaggggccgtaacggggg

SEQ ID NO: 268246 - DNA, 680 bp, Homo sapiens
  misc_feature: GYAE6OF02IGY1K.28.57.F02.1.454.CMB.1.raw
  modified_base (260)..(260): a, c, t, g, unknown or other
  misc_feature (260)..(260): n is a, c, g, or t
  modified_base (285)..(285): a, c, t, g, unknown or other
  misc_feature (285)..(285): n is a, c, g, or t
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttggtccagcctggggggtccctgagactctcctgtgcagcctcnggattcaacctttcagttattttangctatgcacgtgggtccnccaggctccgaggggaaggcgtggaatatgtctcgaggtattaagaagtatgacgaataacatatattangactaaactcgtgtaggaagggtcaagtagtttcaaccctataccgtaccgaaggggtaactaacttacccgaaaagtaaccacgtacgtgttaacttaccttacgtaaaagtcgggtaccaacggtcccgttaggaacggaacgtccgtacggaaacgggaccaaccggggtacttaggtaacgttaagtttaccggttcgggttaaggggaacgggtaggggtaaacgtacggggttaaaggtttacgggttaaaccggtttaggggggtttacggttaccggggggaacccttaaccggggggg

SEQ ID NO: 268247 - DNA, 609 bp, Homo sapiens
  misc_feature: GYAE6OF02IF39Z.28.57.F02.1.454.CMB.1.raw
  modified_base (286)..(286): a, c, t, g, unknown or other
  misc_feature (286)..(286): n is a, c, g, or t
  modified_base (335)..(335): a, c, t, g, unknown or other
  misc_feature (335)..(335): n is a, c, g, or t
  modified_base (373)..(373): a, c, t, g, unknown or other
  misc_feature (373)..(373): n is a, c, g, or t
  modified_base (484)..(484): a, c, t, g, unknown or other
  misc_feature (484)..(484): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttgggtccagccgtggggggtccctgagactctcctgtgcagcctctggattcacccttcagttatttangctatgcacgtgggtccgccgaggcctccgagggaagggactaggaatntgtctcaggtatagaagtatgacaataacatatattangactaaactctgtaggaagggcaagtcttacacctatcctacgaggactaacgttaccaaagaccacgcttagtactcttaacaaagtcgggacacgtccgtagagtacgngtaggaacggaccgacggtacgtagtagttagttaccggtgggttacgggaacggtaagggacggtaacggttaaggttacgggtaaacggtttagggggtcggttacgggggccgtaacggggg

SEQ ID NO: 268248 - DNA, 696 bp, Homo sapiens
  misc_feature: GYAE6OF02I7FHO.28.57.F02.1.454.CMB.1.raw
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccaggccgtggggggtccctggagactcgtcctgtgcagcctcgtggacttccaccttcagttatttatgcttatgcacgttcggggtccnccgtaggcctaccgaaggggtaacggctaggaactagtgtctgaaggttataagaagtatgacgtaataacattatattanagactaaactntaggtacggaaggtcaggtaacttaccaaccgtaattccgtacgtaaacgggtaactaaacgttaccgaaacgaaacgtaacgtacttagttaaccttacttaaacgaaagttcgggaacctacggtaccgttaggaacgtacggtacgttaagggaaccggtacgtaaccgggtagttaccgttagttaacgtttaaccggttggggtaagggaggtaacgggtacgggtaacggtaacgggtttacgggaaacggtttaaggggtcggttaccggggaccggttaacgggg

SEQ ID NO: 268249 - DNA, 566 bp, Homo sapiens
  misc_feature: GYAE6OF02JIMQL.28.57.F02.1.454.CMB.1.raw
  modified_base (261)..(261): a, c, t, g, unknown or other
  misc_feature (261)..(261): n is a, c, g, or t
  modified_base (326)..(326): a, c, t, g, unknown or other
  misc_feature (326)..(326): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
  modified_base (461)..(461): a, c, t, g, unknown or other
  misc_feature (461)..(461): n is a, c, g, or t
  modified_base (483)..(483): a, c, t, g, unknown or other
  misc_feature (483)..(483): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccgttgttaggctatttttaaaggtgtccagtgtgaggtgcagctggtggagtctgggggagcttggtccagccgtggggggtccctgagactctcctgtgcagcctntggattcaccttcagtatttatgctatgcacgtggtccgccaggctccgagggtaggctggaatntgtctcaggtattagaagtatgacgtaataacatatattatgacaactntgtagaggcagtattcactntcaccgaggacaattccaagacctagcttagtactacttagaaagtcgggacacgtacctaggagngtcgtagaacggactacgggtntaagttactagttacgtagggtcgggtaaancgggtagtacgtaagttcgggtaaacgttggggtttggcgggtacaacgggg

SEQ ID NO: 268250 - DNA, 611 bp, Homo sapiens
  misc_feature: GYAE6OF02FWVJR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctcgtggattccaccttcagttatttatgctatgcacgtgggtcccgccaggcctaccgaggggaacgggactaggaatagtgtctcgaggttatagaagtatgacgaataacatatattatgactaactctagtaggaaggcagtacttcacctatcctacgaaggactaactaccaaagacacgtctagtatcttacaagtcgggctacgccgtagagacgctaggaacgaccgacggtacttagttacttacggttacgtagggtaggggtaaggagggaacggtaacggtaaggtttacggggtaaaccggtttaggggttacggggtacggggacccggtaacggggg

SEQ ID NO: 268251 - DNA, 598 bp, Homo sapiens
  misc_feature: GYAE6OF02FETX4.28.57.F02.1.454.CMB.1.raw
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgtgctatttttaaaggtgtccagtgtgaggtgcagctgggtggagtcgtgggggaggcttggtcccagcccgtggggggtccctggagactctcctgtgcagcctcgnggattccaccttcagttattatgctatgcacgtggtccnccaggctccgaggggaggactaggaactatgtctcgaggttattagaagtaatggacgtaataacattaatattactgaacctaaacgtcgtagaggaaggcagtattaccgactatccgtaccgagggacctaacgttaccaaagaacaccgtactagttattaccgtactaaagttcgggacacgtccgagacgaggctagggacacgacgtctagttatatacggtggtagggagtaggacgtaggtaaggttacggaacggttgggtacgggtacggggacgtacgggg

SEQ ID NO: 268252 - DNA, 581 bp, Homo sapiens
  misc_feature: GYAE6OF02IMH77.28.57.F02.1.454.CMB.1.raw
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
tcagagtacgctatcacgaccggtgctcgatttagctcgatatagttgggtttggggggtccctgagactctcctgtgcagcctctggattcaccttcagtatttatgctatgcactgggtccgccaggctccaggggaagggactggaatatgtctcaggtattagaagtaatgcgaataacatatattatgacaaactctgtgaagggcagattcacctatctccagggacaattccaagaacacgctgtatcttacaaatgggacagcctgagagctgagacacggctagtatattacgtggtagggagaggagacggaagttgggaacttaggggtggtggggccgaagggtacgcccgtggtccaccgtctcctcgacgccctcccaaccgacggcccctagtccgtccttacccccgtggccgccctcgcctccgaggcgacccacccgtccgagacgccacgcgccggccgtgggcctcggcctggaccgaacggtaccctacgtcccaagttacgacgttacctacgtcggacggccgggtccgtggtaccgaaggtccggatagacgnangc

SEQ ID NO: 268253 - DNA, 601 bp, Homo sapiens
  misc_feature: GYAE6OF02IVOL9.28.57.F02.1.454.CMB.1.raw
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
  modified_base (482)..(482): a, c, t, g, unknown or other
  misc_feature (482)..(482): n is a, c, g, or t
  modified_base (532)..(532): a, c, t, g, unknown or other
  misc_feature (532)..(532): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagtcttggtccaggccgtggggggtccctggagtactctcctgtgcagcctcgtggattccaccttcagtatttangcttatgctacgtgggtccgccaggcctccgagggagggactggaatatgtctgaggtattaggaagtangactaataacatatattatgactaaactcgtagtaggaagggctagtacttacaacctatcctaccgagggtaaccaacgttaccaaacgtaacacgtacttagtactcttacaaagtcggaacngccgtagacgtgacgtagacggacacggtctagttatacgtacggttggngggtagtaagggacgtaggaacgttacgggaacggttaggggttacgggtacggggtaccgtaacgggg

SEQ ID NO: 268254 - DNA, 560 bp, Homo sapiens
  misc_feature: GYAE6OF02F8R89.28.57.F02.1.454.CMB.1.raw
  modified_base (428)..(428): a, c, t, g, unknown or other
  misc_feature (428)..(428): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttcctgttgctattttaaggtgtccagtgtgaggtgcagctggtggagtcgtgggggagcgttggtccagccgtggggggtccctgagactctcctgtgcagcctcgtggattcaccttcagtatttatgctatgcactgggtcccgccgaggcctccgaggggaagggactgggaatatgtctctaggtattaagaagtaatgacgtaataacatatattatgactaactctgtagagggcagattcacatcgtcaggactaataccaagacacgntgtatctanaatggnagcgtanagngctaggacgacgacggtcttagtattagtacgttgggacggtaaggaaggaggacgggtaagttacgggtaaccgtaggggtttgggtacggggtaccgaacggggg

SEQ ID NO: 268255 - DNA, 731 bp, Homo sapiens
  misc_feature: GYAE6OF02GD8T9.28.57.F02.1.454.CMB.1.raw
  modified_base (311)..(311): a, c, t, g, unknown or other
  misc_feature (311)..(311): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggtcttggtccagccgtggggggtccctgagactcctcctgtgcagcctcgtggacttccaccttcagttatttatgtctatgctacgtcgggtcccncgacggcctaccggaaggggaacgggacgtagggaattacgtgttcctacgtaggttaagttaaggaaagttaagtgaacgtaaataaactattaatttaattagtacgtaactaaaacttcgtaggtaggaacgggtacaaggtactttacccaacctacttccccgtaccggaagggtaacctaaacttacccgaaacgtaacccacgtcttagttacttaccttaaacgaaaggttcgggaccaacggtccgtaggaacgacgtacgtacgggaacggacccgtaacgggtactttaggttattaacgtttacggtgggttaggggaagggtaagggaacgggtacgggttaaaggtttcggggtaaaccgggtttagggggtttacgggggtaccgggggtacccggtaacggggg

SEQ ID NO: 268256 - DNA, 541 bp, Homo sapiens
  misc_feature: GYAE6OF02IDGNF.28.57.F02.1.454.CMB.1.raw
  modified_base (298)..(298): a, c, t, g, unknown or other
  misc_feature (298)..(298): n is a, c, g, or t
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtccnccaggcctccgaggggaaggactggaatatgtctcgaggtattagaagtatgacgaataacatatattangacaaactntgagaagggcagtatcaccatctcgaggacaattaccaagaacacgctgtactacttcaaagtggacacgcctgagngctggaggacacggctagtagtattacgtggtaggaggagggagaggtagttacggaacgttaggggtaggtcggggaccgtagggg

SEQ ID NO: 268257 - DNA, 598 bp, Homo sapiens
  misc_feature: GYAE6OF02FYEOD.28.57.F02.1.454.CMB.1.raw
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcacgtgggtccnccaggctccgagggaggactggaatntgtctgagtattagaagtangacgaatacatatattangacaaatctgtagaaggcagatcacatctcgaggacaattccaagaacacgctgtaacttcttaacaaagtcgggactagacctggaacgagtcgttagacggaacccgacgggtacttacgggttaattaactttacggttggggttaacggggaggtaaaggggtacggaacggggtaaacgttgggtaaaccggggttagggtttcggggtacgggggtaccgtaaccgggggg

SEQ ID NO: 268258 - DNA, 582 bp, Homo sapiens
  misc_feature: GYAE6OF02IKQJV.28.57.F02.1.454.CMB.1.raw
  modified_base (299)..(299): a, c, t, g, unknown or other
  misc_feature (299)..(299): n is a, c, g, or t
  modified_base (334)..(334): a, c, t, g, unknown or other
  misc_feature (334)..(334): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcacgtgggtccnccaggcctccgaggggagggactggaatatgtctnaggttatagaagtatgacgaaataacataatattagtagactaaactctggtagaagggcaggtacttccaacctatctaccgagggacctaattaccgaaacgaaccacgacttagtacttcttacaaagtgggacagcctgaagngcgtggaacgacgacggntagtattatttacgtggtagggagaagggtacgacgggtaagttacgggaacgttaggggtggtacgggggccgtaacggggg

SEQ ID NO: 268259 - DNA, 782 bp, Homo sapiens
  misc_feature: GYAE6OF02HRGPS.28.57.F02.1.454.CMB.1.raw
  modified_base (285)..(285): a, c, t, g, unknown or other
  misc_feature (285)..(285): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcgttggtccaggccgtgggggggtccctgagactctcctgtgcagcctctggattccaccttcagttatttangtctatgctacgtcgggtcccgaccgacggtccgtacccggaagggggaacgggtaccgtaggtaaacgttagttcgtacctcggtaagggttaatttaaaggaaaggttaagtacggtaacgtaaaacttaaataatttaagtttaatttaagtaacggtaactaaaaccgtttcgtaagggttagggtaaacgggtactaacggtactttaacccgaaccgtattacccgaccggtaaagggtaacctaaacgttaacccgaaaaggtaaaccaccggttaccgttacgttaactttaccttaacgaaaggttcggggaccttaacggccgttaggaacggtacgtacgtaagggaaccggaacgtaccgggtacttaaggtaacgtttaacgtttaggtcgggtaaggggtagaacggggtacgtaccggggtaaagtttaccgggggtaaagtttacgggggggtttcggacgggggttacccgaacgggggg

SEQ ID NO: 268260 - DNA, 542 bp, Homo sapiens
  misc_feature: GYAE6OF02HFSWC.28.57.F02.1.454.CMB.1.raw
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (450)..(450): a, c, t, g, unknown or other
  misc_feature (450)..(450): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattcaccttcagtattttatgctatgcacgtgggtccnccaggcctccgaggggaagggactaggaatagtgtctcaggtattagaagtaatgacgaataacatatattatgacaactctgtagaaggnagtatcacntcncgaggacatcaagacacnctntactcttanaagtggcagctgagngtcgagacggacacggtctagtattacgttagngggtagggaagagggagacggtaaggttcggaaggttggggtggcggggactaacgggg

SEQ ID NO: 268261 - DNA, 684 bp, Homo sapiens
  misc_feature: GYAE6OF02JIRE9.28.57.F02.1.454.CMB.1.raw
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttactttagtgctatgctacgtgggtccnccgaggcctccgagggaacggactggaatatgtctcgaggtatagaagtatcgacgtaataacatatattatagactaaactctaggtacggaagggctaggtacttacaaccctattacccgtaccggaagggtaacctaaagttacccgaaaagaaccctacggtccttaggttaacttaccgttaacaaagttcgggaactacggtcccgtaaggagtacggtaccgttagggaacgggtacctaccggggtacttaaggttatttaacggtttaccggtgggttaacggggtaaggaacgggtaacgggtacgggtaagtttacggggaaaccggtttaagggggttcgggttaccggggggacctaaacgggggg

SEQ ID NO: 268262 - DNA, 579 bp, Homo sapiens
  misc_feature: GYAE6OF02IZESJ.28.57.F02.1.454.CMB.1.raw
  modified_base (423)..(423): a, c, t, g, unknown or other
  misc_feature (423)..(423): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagttatttatgctatgcacgtgggtccgccagggctccgaggggaagggactggaatatgtctcaggtattagaagtatgcgaataacatatatatgactaactctgtagagggcagattacacatctcgaggacatacgaacgacacgctnttactcttacaaagtcggacacggcctaggagacgcgtggaacggactacgggcttggttactagtttacgtggttagggacggtaagggacggtacgggtaagttacggggtaaacggttagggggtttcgggttacgggggaccgtaacggggg

SEQ ID NO: 268263 - DNA, 528 bp, Homo sapiens
  misc_feature: GYAE6OF02IILUZ.28.57.F02.1.454.CMB.1.raw
  modified_base (282)..(282): a, c, t, g, unknown or other
  misc_feature (282)..(282): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (464)..(464): a, c, t, g, unknown or other
  misc_feature (464)..(464): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttangctatgcacgtgggtccgcaggctccgagggaaggctggaatatgtctcgaggtattagaagtaatgacgaaataacatatattatgacaaatctgtagaagggcagtattcacatcacgaggacaatccaaagacacgctagtattctanaaagnggacagacngagagctgacgacacgntagtatattacgtgtaggagaggagaggagttaggaacgttagggttggtcgggacgtacgggg

SEQ ID NO: 268264 - DNA, 778 bp, Homo sapiens
  misc_feature: GYAE6OF02IDF0A.28.57.F02.1.454.CMB.1.raw
  modified_base (240)..(240): a, c, t, g, unknown or other
  misc_feature (240)..(240): n is a, c, g, or t
  modified_base (259)..(259): a, c, t, g, unknown or other
  misc_feature (259)..(259): n is a, c, g, or t
  modified_base (334)..(334): a, c, t, g, unknown or other
  misc_feature (334)..(334): n is a, c, g, or t
tcagagtacgctatcacgaccggtgctcgatttagctcgatatagttgggtctggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtgggggaggcttggtccagccgtggggggtccctggngactctcctgtgcagcctntggattcacctttcagttattttatgctatgcacttcgggtccgccaggtctccgaaggggaaggacgtggaatntgtctcgagtattagaagtatagacgtaaataacataatattatacgtacaaacttctaggtaggaagggactaagtatttaccaacctattcctacgaacgggtaacctaaacgtttaccgaaacgaaaccgtaacgttacgtttacgttaacttacccgtttaacgtaaaacggtcggggtaacctaaccgggtacccggtttaggaacgggtaacggttaccggttaaggggaaaccggtaaaccggtaccgggttacgtttaacggtttaacgttttaacgttttaaccgggtagggggttaaccggggtaagggtaacggggggttaaaccggtaacgggggttaaacggtttttaaccggggggtaaaaccggggttttaagggggggttttaacggggggttaccccgggggggaacccgggttaaaccgggggggg

SEQ ID NO: 268265 - DNA, 560 bp, Homo sapiens
  misc_feature: GYAE6OF02FUBI9.28.57.F02.1.454.CMB.1.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctccgtgtgcagcctctggattcaccttcagttatttatgctatgcacgtgggtcccnccaggctccgagggaaggactggaatatgtctcgaggtattagaagtaatgacgaataacatatattangacaaactctgtgaagggcagtacttcacctatcctcaagggactaacttccaaagaacacgctagttatccttacaaagttcgggacacgcctaggagagctaggacgacacggctaggtatattacgtggtagggagaggagacggaagttgggtaacgttagggttggtacggggcctaacggggg

SEQ ID NO: 268266 - DNA, 669 bp, Homo sapiens
  misc_feature: GYAE6OF02ID8I6.28.57.F02.1.454.CMB.1.raw
  modified_base (283)..(283): a, c, t, g, unknown or other
  misc_feature (283)..(283): n is a, c, g, or t
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctagattcaccttcagttatttangctatgctacgttcgggtccgccgaggcctccggaaggggaacgggactaggaatagtgtcacgtaggtaattaggtaaagtaactggacgaaattaaacattaatattanacgtactaaactcgtaggtagaagggtcaacgtattaccaaccatcgtacccgaagggactaaacgttaccaaagaccaaccgtctaacgttatacccttaagaaacgtgggcctaacgccgttaggaagtacggacttagggacggaaacgcggtacttggttaacttagttaaccggtgggttaacggggaaaggacgggtaacggaacggttaaaggtttacgggaaaccgggttttagggggtacgtaccggggggacccgtaacgggggg

SEQ ID NO: 268267 - DNA, 705 bp, Homo sapiens
  misc_feature: GYAE6OF02HGLIG.28.57.F02.1.454.CMB.1.raw
  modified_base (608)..(608): a, c, t, g, unknown or other
  misc_feature (608)..(608): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggatttccaccttcagttatttatgctatgcacgtcgggtccgccgaggcctccggaggggaagggcgtagggaatagtcgtctcgaggttaattaaggaagtaatgacgaaattaacgaattagtaattatacgactaaacttcgtaggtacgggaacgggtctaagtacttaccaaccctattccccgtaacccggtaagggtaaaccctaaacgttacccgaaaacggtaaccacgttacgttacgttaacttccgtttaaacgaaagtcgggaactacggtaccgtaggacgtacgcgttacgggaacgaccgtacggacttaggtactttacgtttaacggnggggtacggggaagtacggggtaaggacgggtttaaacggttacggggtaaacggttttagggggttacggggtaccgggggtaccggtaacggggg

SEQ ID NO: 268268 - DNA, 701 bp, Homo sapiens
  misc_feature: GYAE6OF02IY4D1.28.57.F02.1.454.CMB.1.raw
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtggtccgcnggctccgagggaaggactggaatagtgtctcgaggtattagaagtaangacgaaataacatattaattatgacaaactcgtagtggaaagggcagtacttaccaactacttccaccgaagggaacctaaactttaacccgaaagtaaaccctacggtactttacggttaacttaccttaaacgtaaaacggttcggggaaccttaacgggacccgttagggaacgtacggtccgtacgggaacgggtaaaccgtccgggtacttacggttaactttaacgttaccggtagggggttagggaacgggtaacggggtaacgggtacggttaacgggttaacggggttaaaaccggtttaggggggtttacggggtaccggggggtaaccggtaacgggggg

SEQ ID NO: 268269 - DNA, 556 bp, Homo sapiens
  misc_feature: GYAE6OF02I5VRI.28.57.F02.1.454.CMB.1.raw
  modified_base (356)..(356): a, c, t, g, unknown or other
  misc_feature (356)..(356): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtcccgccgaggcctccgaggggaacgggactggaatatcgtctcaggttattaagaagtaanganaataacatatattangacaactntgtgaagggcagatcacatctcgaggacaataccaagaacacgcttagtactcttacaatcggacacgtcctagagacgctaggaggacgacggctagtatattacgtggtaggaggaggacggaggtaagttagggtaacggttagggttacgggtacgggccggtaacgggg

SEQ ID NO: 268270 - DNA, 685 bp, Homo sapiens
  misc_feature: GYAE6OF02F6366.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctggagactctcctgtgcagcctctggattcaccttcagttatttatgctatgcacgtcgggtcccgccgaggcctccgaggggaacgggactggaatatgtctcgaggttattagaagtaatgacgaataacattaatattatgaactaaactctaggtaggaagggctaggtacttaccaacctatcccgtaccgaagggaactaacgttaccaaacgtaaccacgacttagttacttcttaacgaaagtcgggacaacggtacccgttagaacggtacgtaccgttaagggaacggacccggtaacgggtactttagttaacttacggtttaacgttcgggggttaaggggaagggtaaggggaacggttaaccgggtaaaggtttacggggtaaacggttttaggggggtttcggggtaacgggggtacccgggtaacggggg

SEQ ID NO: 268271 - DNA, 355 bp, Homo sapiens
  misc_feature: GYAE6OF02IC1KL.28.57.F02.1.454.CMB.1.raw
  modified_base (298)..(298): a, c, t, g, unknown or other
  misc_feature (298)..(298): n is a, c, g, or t
  modified_base (334)..(355): a, c, t, g, unknown or other
  misc_feature (334)..(355): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacgggagtttgggctgagctgggttttccttgttgctatttttaaaaggtgtccagtgtgaggtgcagctggtggagtctgggggagcttggtccagcctggggggtccctgagactctcctgtgcagcctctggattcaccttcagtattatgctatgcactgggtccnccaggctcgagggaaggactaggaatagtgtctacnnnnnnnnnnnnnnnnnnnnnn

SEQ ID NO: 268272 - DNA, 599 bp, Homo sapiens
  misc_feature: GYAE6OF02IZWRW.28.57.F02.1.454.CMB.1.raw
  modified_base (504)..(504): a, c, t, g, unknown or other
  misc_feature (504)..(504): n is a, c, g, or t
  modified_base (548)..(548): a, c, t, g, unknown or other
  misc_feature (548)..(548): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtcgcagcctctggattccacctttcagttatttatgctatggctacgtgggtcccgccagggcctccgaaggggaacggggacctagggaaacttgtggtctacgtaggttaattaaggaaagtaattggacgaaatacaataatattatgactaaactctggtagaagggcaagacttcaaccatcctacgaagggactaattccaaagacacgtctagtatccttacaaatcgggacagacctagaacgngacgtagagacacggctagtattacgttacgtggtcgggaaggngaggacggtaagttagggtaacgttaggggttcggttagggccgtaagggg

SEQ ID NO: 268273 - DNA, 644 bp, Homo sapiens
  misc_feature: GYAE6OF02F0JC3.28.57.F02.1.454.CMB.1.raw
  modified_base (310)..(310): a, c, t, g, unknown or other
  misc_feature (310)..(310): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgacgactctcctgtgcagcctcgtggacttccacctttcagttatttatgctatcgctacgtcgggtccnccgaggcctccgaggggaaggactggaatagtgtctcgaggttattagaagttaatgacgaataacattaattattatgactaaactcttaggtaggaacgggcagtacttaccaccgtatcccgtaacggagggaacctaacgttacccgaaagaacccgtacgtacttacgttaacttacttaaccgaaaaggtcgggaaccaggtaccctagggacgtacgtcgtaacggacggtacgacgtcttagttactagttacggtggtagggacgtaagggcgtaacggttaagttacgggtaaaggttggggtcgggtaccgggacgtacgggg

SEQ ID NO: 268274 - DNA, 829 bp, Homo sapiens
  misc_feature: GYAE6OF02HEUY1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgacgactctcctgtgcagcctctggattcaccttcagttattatgctatgcacgtcgggtccgccgacggcctaccgaaggggaacgggacgtaggaatagttcgttacgtcgtaaggttagttaaggtaaagttaagtacggtacgtaaataaacgtaattaactttaagtttaacttacggtaaccttaaaaccgttaccgttagggttaacggtaaaggggtacgtaaggtaacttttacccgaaacccttaacgttacccgttacccgggaacggggtaaaccttaaacgtttaacccgaaaacgtaaacccgaaccgtccgttagtttaacgttaccctttaacgtaaaacggttcgggacgttaaccgggtaccgttaggtaacggaacggtcggttaacggaacgggtaaccggtaaaccgggttaccgtttagtaacgttttacgtttaacgggtttaggggtaacggggttaacggggaaggggtaaccgggtaacggggtttaaacggtttaacgggggttaaacgggtttacgggggggtttacggggtaccggggggtaacccggttaacccgggggg

SEQ ID NO: 268275 - DNA, 646 bp, Homo sapiens
  misc_feature: GYAE6OF02HA572.28.57.F02.1.454.CMB.1.raw
  modified_base (253)..(253): a, c, t, g, unknown or other
  misc_feature (253)..(253): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgagtgcagctggtggagtcgtgggggagcgttggtccagcctggggggtccctgagactctcctgtgcngcctctggattcaccttcagtatttatgctatgcacgtgggtccgccaggcctccgaggggaagggactggaatagtgtctcgaggttattaagaagtaatgacgtaataacatatattatagactaaaactcgtagtaggaacgggctaagtacgttaccaacctacttccctaccggaacgggtaactaaacgttacccaaagtaaacccgacgtctaggtttactccttactaaaaggtggtacctaacggtcctaggacgtacggtcgtaacggacgggtacgaacggtacgtacggttattacgttaacggtgggtagggaaggaagggtaggtacggtaaggttacggaacggttaggggtttaggtacggggtaccgtaacggggg

SEQ ID NO: 268276 - DNA, 588 bp, Homo sapiens
  misc_feature: GYAE6OF02FKYBA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtggtccgccaggcctccgaggggaaggctgggaatatgtctcaggtattagaagtaatgcgaataacatatattatgacaaactctagtaggaagggcagtattccacctatcctccgaagggacctaacgttacccaaagaacctacgcttagttattaccttaacgaaagttcgggacacgtaccgtagacgagtcgtaggacggtacgacggtctagtatacgttacgtggtagggaggaagggagacggtaagttacggaacgttaggggtttaggtcggggaccgtacgggg

SEQ ID NO: 268277 - DNA, 566 bp, Homo sapiens
  misc_feature: GYAE6OF02FVJ3S.28.57.F02.1.454.CMB.1.raw
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
  modified_base (445)..(445): a, c, t, g, unknown or other
  misc_feature (445)..(445): n is a, c, g, or t
  modified_base (453)..(453): a, c, t, g, unknown or other
  misc_feature (453)..(453): n is a, c, g, or t
  modified_base (510)..(510): a, c, t, g, unknown or other
  misc_feature (510)..(510): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggtaaggactggaatagtgtctcaggttattagaagtatgacgaataacgatatattatgactaaagtctagtagaagggcagacttacaccatcctcgaggaactacttaccgaagaacncgactgtatccttanaatggacncgactgagagcgtgacgacgacggtctgttatagttacgtggttaggaagggtacgnggacgggtaagttcgggtaaccgttaggggttagggtacggggaccgtaacggggg

SEQ ID NO: 268278 - DNA, 592 bp, Homo sapiens
  misc_feature: GYAE6OF02IAXRE.28.57.F02.1.454.CMB.1.raw
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (340)..(340): a, c, t, g, unknown or other
  misc_feature (340)..(340): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctggagactctcctgtgcagcctctggnttcacctttcagttatttangctatgcacgtgggtccnccgaggctaccgaggggaagggctggaatatgtctnaggtatagaatatgacgaataacatatatangacaactctgtagaggcagactcacatcaccgaggacaattaccaagaacacgctagtactcttaacaagtcgggacacgcctaggagtagccgtaggaacggacgacggtcgttagtacttagttaccggtgggtacggggaaggtaacgggtaggtaacggttaaggtttacggggaaacggtttagggggtcgggtacgggggacccgtaacgggggg

SEQ ID NO: 268279 - DNA, 644 bp, Homo sapiens
  misc_feature: GYAE6OF02IDJYZ.28.57.F02.1.454.CMB.1.raw
  modified_base (239)..(239): a, c, t, g, unknown or other
  misc_feature (239)..(239): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtctggggggaggcttggtccagcctggggggtccctgngactctcctgtgcagcctctggattcaccttcagtatttatgctatgctacgtgggtccaccgaggctccgagggaagggactggatatgtcacgaggtatagaagtaatgacgaataacataatattangacaaactngtgaagggcagattcacatctccaggaacacttaccgaagtaacacgacctagtactcctttacgaaagttcgggactaacggtcccgtaggaacggtaaggcgttaacggaacgggaccgtaacgggccttaaggtaacgtttaagttaccgtcgggttaagggggtaaccggaaggggttaaccgaaccgggggttaagttaaccggggaaacgggttttaaacgggggtttgggtaccgggggggttcccggaaacggggggg

SEQ ID NO: 268280 - DNA, 586 bp, Homo sapiens
  misc_feature: GYAE6OF02I520P.28.57.F02.1.454.CMB.1.raw
  modified_base (330)..(330): a, c, t, g, unknown or other
  misc_feature (330)..(330): n is a, c, g, or t
  modified_base (413)..(413): a, c, t, g, unknown or other
  misc_feature (413)..(413): n is a, c, g, or t
  modified_base (478)..(478): a, c, t, g, unknown or other
  misc_feature (478)..(478): n is a, c, g, or t
tcagagtacgctatcacgaccggtgctcgatttagctcgatatagttgggtctgggagaggagcccccgccctgggcttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttgggtccagccgtggggggtccctgagactctcctgtgcagcctctggattcaccttcagttatttatgctatgcacgtgggtccgcaggctccgaggggaggactaggaatntgtctacgtaggtattaagaagtaatgacgaataactaatattattatagactaaactctagtagaaggcagactacacatcncgaaggacaactaccaaacgactacgctagtactacgtactaaagtggacacgccgtagaacggngcgtagaacggacgacggtcgtagttacttagttacgttaggtaggggaacgtaagggaggtaacggtaggttagggtaaggtttggggttaggtggggtaaccgggg

SEQ ID NO: 268281 - DNA, 671 bp, Homo sapiens
  misc_feature: GYAE6OF02JQ6QV.28.57.F02.1.454.CMB.1.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagccgtggggggtccctggagctcgtcctgtgcagcctctggattccaccttcagttatttangtcttatgactacgtcgggtcccnccgaggcctacccggaaggggaacgggcctagggtaacttagtcgttcctcgtaggttagttaagaaaggttaactaggacgtaaataaacattaattaatttatacgactaaactcgtagtaggaacgggtcaggtacttaccaactactccgtacgaagggtactaacgttaccgaaagtaaccacgtactagtactactacgtaaagcggtcacgtcaggacgacgtgtagacggtaacgacggtactagttacttagtacggtacggggttaggaagggtaagggtacggtaacgggttagttaaccgggggtaagtttacggggggtacggttacggggggaccgtaaccggggg

SEQ ID NO: 268282 - DNA, 611 bp, Homo sapiens
  misc_feature: GYAE6OF02GU3H1.28.57.F02.1.454.CMB.1.raw
  modified_base (466)..(466): a, c, t, g, unknown or other
  misc_feature (466)..(466): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctggagctctcctgtgcagcctctggattcaccttcagttatttatgtctatgctacgtgggtcccgccgaggcctccgaggggaagggcgtggaatagtgtctcgaggtattaaggaagtaatgacgaataacattaatattatcgactaaactctgtagaagggtcagtacttcgacctatcgtaccgaggaacaacttaccaaagaacctacgctaggtatccgttanaacgttcgggctacgtccnggagtcgcgtacggngaaccgacggtcttacggtattacgttacggtaggtcggggaaggacgggtcggtaacgggtaagtttcgggaaaggttaggggtttcgggacgggtaccgggtaacgggg

SEQ ID NO: 268283 - DNA, 626 bp, Homo sapiens
  misc_feature: GYAE6OF02JD8HP.28.57.F02.1.454.CMB.1.raw
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
  modified_base (486)..(486): a, c, t, g, unknown or other
  misc_feature (486)..(486): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtctgggggaggcgttggtccagccgtgggggtccctgagactctcctgtgcagcctctggacttccaccgttctacgtatttatgtctatgctacgtggtccgcgacggtctccgagggaagggactaggactatgtctagacggtagtagtaagtagtgtacggaactaaacattaatattatagactaactctaggtagaagggtcagtacttaccactacgtacaccgaggtactaactacctaagaacncggtctaggttactccgtanaaaggtgggtacncgtaccgtagacgtagactcggaagtaccgacgtcgtagtagttacgtacgtgggttagggaacggtagggtaacgtacgggttaacgtttacgggaaccgggttttaaggggcgggttacggggacccggtaacggggg

SEQ ID NO: 268284 - DNA, 527 bp, Homo sapiens
  misc_feature: GYAE6OF02GDHTF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccaggggaaggctggaatatgtctcaggtattagaagtatgcgaataacatatattatgacaaactctagtgaagggcagattcaccatctcaaggacaattccaagaacacgctgtattcttacaaatcgggacacgcctgagagctgagacacgctgtatatacgtgtaggagaggagacggtaattaggaacgttaggggtagtggggcctaacgggg

SEQ ID NO: 268285 - DNA, 545 bp, Homo sapiens
  misc_feature: GYAE6OF02H18ML.28.57.F02.1.454.CMB.1.raw
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtcccgccaggcctccgagggaagggactggaatatgtctcgaggtatagaataatgacgaataacataatattatgacaaactctaggtagaagggcaagatcactatctaccgaagggacaacttaccaaagaacaacgcttagtactcttacaaatcgggctacgcctagagagctagagcaacggntagtatatacgtgtggagaggacgnggtaagttaggaacgttagggttgtacggggctaaggg

SEQ ID NO: 268286 - DNA, 785 bp, Homo sapiens
  misc_feature: GYAE6OF02I38EF.28.57.F02.1.454.CMB.1.raw
  modified_base (583)..(583): a, c, t, g, unknown or other
  misc_feature (583)..(583): n is a, c, g, or t
  modified_base (669)..(669): a, c, t, g, unknown or other
  misc_feature (669)..(669): n is a, c, g, or t
  modified_base (695)..(695): a, c, t, g, unknown or other
  misc_feature (695)..(695): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggtagtttgggctgagtctgggttttccttgttgctaatttttaaaggtgtcagtgtgaggtgcagctggtggagtcgtgggggtagtcttggtccagccgtgggggtccctggacgacctctcctgtcgcagcctctggattccgtaccttcaaggttattttatgtcttatgactacggttcgggtcccgaccgagggtcctaccggaagggggaaacggggtacctagggaaactttacgttacgttaccgttacgtaacgggttaatttaaaggtaaaagttaacgttacggaaaccgtaaaattaaaacctagtttaaattaagtttaatacgtaaacctaaacgttcgtaggtaggaaacgggtctaaaggttacttaccccgaactacgttcccgtaaccgggaaggtaaaccctaaacgttacccgaaagaacccgaaccggttnttaacggttaacctttcgttaaacgaaaggttgggacctaacggtccttaggacgtggtacgttacggaacggtacccgtacggtnttaacggttattaaccggtttaaggnggggtaacggaagggtaacggggtaggtaacgggttaagttacggggttaaccggttaaggggtttcgggaccgggggaccctaaggggg

SEQ ID NO: 268287 - DNA, 566 bp, Homo sapiens
  misc_feature: GYAE6OF02GTFJG.28.57.F02.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgctatttttaaaggtgtccagtgtgaggtgcagctggtggagtcgtgggggaggcttggtccagccgtggggggtccctggagactctcctgtgcagcctctggattcacttcagtatttangctatgcactgggtccncaggctccgagggaaggctggaatatgtctcgaggtatagaatatgacgaaataacatatatatgacaaatctgagaagggcagtatcacagtctaccaggaacaattccaaagacacgctgtaattctaanaaagtgggacacgctgaacgtagcgtaggaacggaccaacgggtctagttacttaatttacggtgggtaagggaaggtaagggagtacgggtaagttagggtaacgtagggggtttgtacgggggccgtaacgggg

SEQ ID NO: 268288 - DNA, 620 bp, Homo sapiens
  misc_feature: GYAE6OF02GFACQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccgccaggcctccgaggggaaggctggaatagtgtctcgaggtattagaagtaatgacgaataacatatattatgacaacttctagtaggaaggcagattcactatcgtaccgagggaacaacgttaccaaacgaccacgtactagtaacttcttaacgtaaagtcgggacacgacctaggacgagtcgtagaacgggacctacgggacttacgttattacgtttacggttgggtagggtaaggaaggggtacggagggttaaacgtttaggggtaaaccggtttagggggttacgggttacgggggaccggtaaacggggg

SEQ ID NO: 268289 - DNA, 669 bp, Homo sapiens
  misc_feature: GYAE6OF02GV6ZQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgttgggtcccgccgaggcctccgaggggaacgggactggaatatgtctcgaggtattagaagtaatgacgaataacatatattatgactaactctgtaggaagggcagtattaccactactcctccgaagggactaacttaccgaaagtaaccgacgtcttagttacttccgttacaaacgttcgggactacgtcctaggacggacgtacgtaggtaacgggaccgtacgggtacgttacggttacttacggtttaaccggttggggttagggggtaacgggtaacggggtaacggggtaacgggttaacgggttttacgggaaaccggggttttagggggtttacggggttacggggggacccggtaaccggggggg

SEQ ID NO: 268290 - DNA, 547 bp, Homo sapiens
  misc_feature: GYAE6OF02GHKNU.28.57.F02.1.454.CMB.1.raw
  modified_base (296)..(296): a, c, t, g, unknown or other
  misc_feature (296)..(296): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagactctcctgtgcagcctctggattcaccttcagtatttatgctatgcactgggtccncaggctccgagggaaggactggaatatgtctcaggtattagaagtaatgacgaataacgataatattatgacaactctagtagaagggcagtacttcacatctcagggacaattccaaagacacgctagtactcttacaaatgggcagacctgagacgctgaacggcaacgggcttaggtattagttacgtggtacgggagtaggagacgggtaattcgggaacgttgggtcggtacggggctaacggggg

SEQ ID NO: 268291 - DNA, 612 bp, Homo sapiens
  misc_feature: GYAE6OF02ITRTV.28.57.F02.1.454.CMB.1.raw
  modified_base (471)..(471): a, c, t, g, unknown or other
  misc_feature (471)..(471): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggcctccgaggggaagggactagggaatagtgtctcgaggtatagaagtatgacgaaataacataatattatgactaactctgtaggaagggcagtacttacacctatcctacgagggacaacttccaaagacctacgactagtaacttcttaacaaaggtcgggaccncgtacctaggagactcgtaggaaccggaacgtaccggtcttaggtattaacgtttacggtggttacggggaagagggtacgggtacggtaaggtttacgggaaccgttagggggttaggtccgggggtaccgtaacggggg

SEQ ID NO: 268292 - DNA, 658 bp, Homo sapiens
  misc_feature: GYAE6OF02G2UYI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagttcgtgggggaggcttggtccagccgtggggggtccctgagactctcctgtgcagcctctgacttccacctttcgagttattttatgtctatcgctacgtcgggtcccgccgaggtccgtaccgaaggggaacggtacgtaggtaatcgtcgtctacgaggttaacttaaggaaagtaagtagacgtaaataataattaattattactcgaactaaacttcgtaggtaggaacgggtatagtaacttaccacctactccgtaccggaacggaacttaaactaaccgaaagaacccgtacgtcttagttaacttactaagaaacgtgggacacggtccgtaagacgacgacgtagacggacgaccgttgttagtattagttaggtgggtacggtaggaggtacggtaacgggttaagttagggtacggttaggggtaccggtacgggacgtacgggg

SEQ ID NO: 268293 - DNA, 627 bp, Homo sapiens
  misc_feature: GYAE6OF02IYVM9.28.57.F02.1.454.CMB.1.raw
  modified_base (285)..(285): a, c, t, g, unknown or other
  misc_feature (285)..(285): n is a, c, g, or t
  modified_base (492)..(492): a, c, t, g, unknown or other
  misc_feature (492)..(492): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttagctatttttaaaggtgtccagtgtgaggtgcagctggtggagtcgtgggggaggcgttggtccagccgtggggggtccctgagactctcctgtgcagcctctggattcaccttcagttatttangtcctatgcacgtcgggtccgccgaggccttaccgaaggggaacgggtctaggaacttagtcgtctcgtaaggtattaggaagtatgacgaataacataattacttatgaacaactcgtagtaggaggcagtacttccaccatctacgaggactaactcaaagacacgtctagtattacctagaacgtcgggactacgacctggtanacggtacgtacgggaacgggaacctaacggggtctttacgggttattaccgttaggtagggttacgggaaggtaaggtacggacggttaagttcggtaaacgggttgggggttacggtacggggaccggtacggg

SEQ ID NO: 268294 - DNA, 578 bp, Homo sapiens
  misc_feature: GYAE6OF02GUCIT.28.57.F02.1.454.CMB.1.raw
  modified_base (302)..(302): a, c, t, g, unknown or other
  misc_feature (302)..(302): n is a, c, g, or t
  modified_base (389)..(389): a, c, t, g, unknown or other
  misc_feature (389)..(389): n is a, c, g, or t
  modified_base (400)..(400): a, c, t, g, unknown or other
  misc_feature (400)..(400): n is a, c, g, or t
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (452)..(452): a, c, t, g, unknown or other
  misc_feature (452)..(452): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggattcaccttcagttactttatgctatgcacgtgggtccnccgaggcctccgaaggggaggactggaatatggtctcgaggtattaagaagttaatgacgtaataacattatattatgactaaactntggtagagggnagacttcactanctcgaggactattaccaagaacncgtntagtactccttanaagtcgggactcgacctagacgagcgtagacggacgcggtctaagtacttagtaccgtgggtaggaggtacgggagtcgggtaattcgggaacgggtttagggtaggtaccggggactaacggggg

SEQ ID NO: 268295 - DNA, 544 bp, Homo sapiens
  misc_feature: GYAE6OF02HUEYH.28.57.F02.1.454.CMB.1.raw
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtcccctgagactctcctgtgcagcctctggattcaccttcagtattttatgctatgcacgtgggtcccgcaggcctccgagggaagggactggaatatgtctcaggtattaagaagtaatgacgaataacatatattangacaaactctgngaagggcagatcacatcncaggacaatcaacgacacgctagtactcttacaaagtgggcagaccgtgagagctagacggacacgggtctagtactagttcgtaggtgggagagggagcggtaagttcgggaacgttaggggttggtcgggccgtagggg

SEQ ID NO: 268296 - DNA, 735 bp, Homo sapiens
  misc_feature: GYAE6OF02H6NLY.28.57.F02.1.454.CMB.1.raw
  modified_base (240)..(240): a, c, t, g, unknown or other
  misc_feature (240)..(240): n is a, c, g, or t
  modified_base (633)..(633): a, c, t, g, unknown or other
  misc_feature (633)..(633): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggtttccttgttgctattttaaaggtgtccagtgtgaggtgcagctggtggagtcgtgggggaggcgtggtccagccgtggggggtccctgngactctcctgtgcagcctctggattccgaccttcagttatttatgctatgcacgttcggtccgcccgaggcctccgaaggggaacggtacgtaggaatactgtactcgtaggtattagaaagtaagtacgacgtaaataacgtaatattaattaagtacgtacctaaaacttaccgtaggtaacgggtaagggctaaggtaacttcccaaacccgttagtacccgttacccggaaagggtaaccctaaacgttacccgaaagtaaccgaccgtaaccgttacgttaattacccgtttaaagtaaacggtccgggtaccgtaaaccggtccgtagaacggtacgacgttaggacgggttaccgacgtaccggttattacgttaacgtttacggngggttaccggggaaggaacgggtaccggtacggggttaaacgttagggtaaaccgggtttagggggggtttacggtaccggggggacccgttaacggggggg

SEQ ID NO: 268297 - DNA, 785 bp, Homo sapiens
  misc_feature: GYAE6OF02JHRHJ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactcgtcctgtgcagcctctggattccaccttcagttactttagtcgcttatcgtccacgtcggggttcccgccgacggtccttcccggaaggggaacgggtacttagggaaactagttcggtacctacgtaagggttaattaaggaaaggttaagtcggaacggtaaaacttaaactagttaaagttaacgtttaacgtacgtaacctaaaaccgtttcgttaggttaacgggaacgggtactaaggtaacctttacccgaaccctaacgttacccgttaccggaaacggggtaaccttaaaccgttaacccgaaaacgtaaccctacgttaccgttacgttaacttaccgttaacgtaaaacggtcgggaacctacggtacccgttaagggacggtaacggtaccgtagggaaacggtacccgtaagggtccttaaggttacttacggtttaccggtagggtacggggaaggtagggtacgtaacgggttaagttacgggtaacggtttaggggtagggttaccggggacggtaacgggg

SEQ ID NO: 268298 - DNA, 662 bp, Homo sapiens
  misc_feature: GYAE6OF02G37VF.28.57.F02.1.454.CMB.1.raw
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggagcgttggtccagccgtggggggtccctgagactctcctgtgcagcctcgtggattcaccttcagttatttangtctatgcacgtgggtccgccaggcctaccgaggggaaggactggaatagtgtcctanaggttaataaggaagtaangacgaaataacattaattatatgactaaactcgtaggtaggaagggtcaagtataccacgtatccgtacgaggaactaacttaccgaaagaccacgtcttagtaacttactacaaaggtgggaccaggtaccctaggaacgtacgtaccgtaggaacggaccgtaacgggtccttaagttacgttaaaccgtttaggttggggtaaccggggaaggaagggtaacgggtaaccgggttaaagtttacgggggtaaaccgtttcgggggggtaagttaccggggggacccgtaacgggggg

SEQ ID NO: 268299 - DNA, 608 bp, Homo sapiens
  misc_feature: GYAE6OF02GO1FK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattccaccttcagttatttatgctatgcacgtgggtccgccgaggcctccgaggggaacgggacgtggaatagtgtctcgtaggtattaagaagtaatgacgaaataacataatattatgactaaactctagtaggaagggtcaagtacttacacctataccgtaccgaacgggtaactaacttaccaaagaaccacgtactagttaacttactacaaagtgggacagccgtagagagcgtaggaacggacgacggtcttagtacttagttacgtgggtacgggagaagggagacggtaagttacgggaacgtttaggggttcgggtacggggacgtaacgggg

SEQ ID NO: 268300 - DNA, 703 bp, Homo sapiens
  misc_feature: GYAE6OF02FH6LE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcgagcgtggtggagtcgtgggggaggcgttggtccagccgtggggggtccctgagactctcctggtcgcacgcctcgtggtacttccacccttcaagttatttatgcttatgctacgttggggtccccgcccgagggtccctaccggaacgggggaacggtaccgtagggaaattagtcgtctcgaaggttattaagaaagtaatgacgaaataactattaatattatgaactaaacttcgtagaggaacgggcaagtattacgacctatccctacggaaggaacctaacgttaccaaacgtaaaccacggtactacgttactccttaacgaaaggttcgggacgtaacggcccgttaggagtaacggtccgtaaggaacggtaccggacgtaccgtgttaacttaagttaccggttagggtaaggggaagggtacgggtaagggtaacgggttaaggttaacgggtaaacgggttaggggttaggggtaccgggggtacccgtaacgggggg

SEQ ID NO: 268301 - DNA, 561 bp, Homo sapiens
  misc_feature: GYAE6OF02FGO8C.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgctatttttaaaggtgtccagtgtgaggtgcagctggtggagtctgggggaggcttggtccagccgtgggggggtccctggagactctcctgtgcagcctctggattcacctttcagtatttatgctatgcactggtccgccaggctccgagggaaggctggaatatgtctcaggttattagaagtaatgacgaataacattatattatgcaaaacttcagtgaagggcagattcaccatctccgaggacaacttccaagacacgtctgtactcttacaagtgggacacgcctagacgagctagacgacgacggtctagtatagttaccgtggtagggaggtaggaggacgggtaacgttagggaacgtttagggggtttggtacggggcgtaacggggg

SEQ ID NO: 268302 - DNA, 744 bp, Homo sapiens
  misc_feature: GYAE6OF02JIIZY.28.57.F02.1.454.CMB.1.raw
  modified_base (276)..(276): a, c, t, g, unknown or other
  misc_feature (276)..(276): n is a, c, g, or t
  modified_base (335)..(335): a, c, t, g, unknown or other
  misc_feature (335)..(335): n is a, c, g, or t
  modified_base (408)..(408): a, c, t, g, unknown or other
  misc_feature (408)..(408): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctggagactctcctgtgcagcctctggattcgaccttnagttatttatgctatgctacgtgggtccgcgaggctaccgaggggaaggactaggaatntgtctcgtaggtataagaagtatgagtaaagtaacattaatattatacgaactaaactcgtagtaggaagganagtaactttaccacctattacccgtaccggaaagggtaaccttaacttaacccgaaaacgtaaccgaccgtacgttagttaaccttccttaaacgtaaaaggtccgggtaccgtaaccggttacccgtaggaaacggtaacggtacccggtaagggaaaccggggaaaccgtaaccgggttacgtttaagttaacgttttaacggttaacggtttagggggtaaccggggtaagggtaacggggtaaacgggtaaccgggggttaaacgtttaacggggttaaaccgggtttaacggggggttagggttaccgggggggacccggtaaacgggggg

SEQ ID NO: 268303 - DNA, 601 bp, Homo sapiens
  misc_feature: GYAE6OF02FVV4U.28.57.F02.1.454.CMB.1.raw
  modified_base (306)..(306): a, c, t, g, unknown or other
  misc_feature (306)..(306): n is a, c, g, or t
  modified_base (385)..(385): a, c, t, g, unknown or other
  misc_feature (385)..(385): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaaccttcagttatttatgactatgcactgggtccgccnggcctccgaggggaggccgtggaatgtgtctcgaggtattagaagtaatgacgtaataacatatattatgactaaactntagtagaagggnagacttacactatcctacgagactaattacgaanacacgctagtatctacaagttcggacgtacgccgttaggacgacgtcgttacgggaacgacgtacggtccttaggtactttagtacgttagggaggggtaaggaacggagtaacgggtaagttacgggtaaccggttaggggggttacgttacgggggaccgtaacgggg

SEQ ID NO: 268304 - DNA, 619 bp, Homo sapiens
  misc_feature: GYAE6OF02FUB58.28.57.F02.1.454.CMB.1.raw
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctccgtgtgcagcctctggattcaccttcagttatttatgctatgcacgtgggtcccgccgaggcctccgaggggaaggacgtaggaatagtgtctcgaggttattaagaagtaatgacgaataacatatattangacaaactcgtagtaggaagggcagtacttaccacctatccacgagggaacctaacttaccgaaacgaaccacgtactagttacttcttacgaaagtcgggaccacgcctaggagcgtacgtaggaacggacgtacggcttagttagtacttacggtggtagggaacggtagggacggtagggtaacggttagggtaaaccggttaggggtttacgggtacgggggaccggtaacgggg

SEQ ID NO: 268305 - DNA, 683 bp, Homo sapiens
  misc_feature: GYAE6OF02IRCAD.28.57.F02.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
tcagagtacgctatcacgaccggtgctcgatttagctcgatatagttgggtctgggagaggagcccccgccctgggtttcccaggtgttctcatttggtgatcagcactgcacaccagaagagtcatgacggagtttgggctgagctgggttttccttgttgcttattttttaaaggtgtccagtgtgaggtgcagctggtggagtctgggggaggcttggtccagcctggggggtccctgagactctcctgtgcngcctctggattccaccttcagttatttangctatncacgtcgggtcccnccgaggcctccgaggggaagggactagggaatntcgtctcaggtaattagaataatgacgaataacataatattatagactaaactcgtagtaggaagggctaaggtacttaccgaaacctagtaccgaccgtaacggggaacctaaacttccccggaaaagtaacccgtaacggtacttagttaacgttaccgtttaactaaacggtcgggaccaaggtcccttaagggacgaacggtacgtagggaacgaaccgtaacgggacccttaggttaattaaccgtttaaggtcgggttaagggaagggaagggacgtagggttaaacttaggggtaacccggttaaggggtttcgggtaccgggggcccgtaaaggggg

SEQ ID NO: 268306 - DNA, 610 bp, Homo sapiens
  misc_feature: GYAE6OF02IEYFZ.28.57.F02.1.454.CMB.1.raw
  modified_base (365)..(365): a, c, t, g, unknown or other
  misc_feature (365)..(365): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctgggttttccttgttgctatttttaaaggtgtccagtgtgaggtgcagctggtggagtctggggggaggcttggtccagccgtgggggggtccctgagactctcctgtgcagcctctggattcacctttcagtattttatgcttatgcacgtgggtccgcccgaggcctccgaggggaacgggactagggaatatgtctcgaaggttattagaagtaangacgaataacatatattatgactaaactctgtagaagggcagattcacctatcncgaggacaattaccgaanaacacgtctagtatcttacaaagtcgggacacgtccgtagacggagccgttaggaacggacgacggtcttaggttattaagtttacgtgggtacggggtaaggaagggtacggaagggtacggttacgggtaacggtttagggggttagggtcgggggtaccgtaacgggggg

SEQ ID NO: 268307 - DNA, 642 bp, Homo sapiens
  misc_feature: GYAE6OF02G331E.28.57.F02.1.454.CMB.1.raw
  modified_base (505)..(505): a, c, t, g, unknown or other
  misc_feature (505)..(505): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcttggtccagccgtggggggtccctgagactctcctgtgcagcctcgtggattcaccttcagttatttactgtctatcgacacgtcggggtccgccgaggcctaccgaaggggaaggactggaatagtgtacgtcgaaggttattaaggaagtaacgtgaaccgtaaataactaataagtttaattacgtagtactaaaaccttcgtaggtagaagggtacaagtagttaccacaattccgtaccgagggaactaacgttaccgaaagaacctacgcgtagttaacttctaanaaaggtcgggaactacggccgtaggaagagcgtaggaacggacgtacgggatacgtagttacgttacggtgggtaggtacggagggtagacggtaggttacggtaacggttagggtcgggtaggggaccgtacgggg

SEQ ID NO: 268308 - DNA, 596 bp, Homo sapiens
  misc_feature: GYAE6OF02FLGAK.28.57.F02.1.454.CMB.1.raw
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtggggggaggcgttggtccagccgtgggggggtccctggagactctcctgtgcacgcctcgtgattcacccttcagttatttatgctatgcacgtgggtcccgccgaggcctccgagggaaggacgtggaatagtgtctcgtaggtattaggaagtaagtgacgaataacataatattangacaactctgtagaagggnagtnttacactntctacgaggactaactacaagacacgntagtatactactaaatgggacagcgtagagacgcgtagaacgaccgacgggacttagttattagttacgtgggtagggaagggaggtaacggaggttaacggttagggtaaacggtttagggggttcgggtacgggggccgtaacggggg

SEQ ID NO: 268309 - DNA, 544 bp, Homo sapiens
  misc_feature: GYAE6OF02F8TVI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtggtccgccaggctccgagggaagggctaggaatatgtctcaggtattaagaagtaatgacgaataacatatattatgactaaactctgtagaacgggcagattcacatctcgagacaattaccaagaacacgctgtatctacaatgggacagcctgacgagcgtagacggacgacggcttagtatattacgtggtagggaggaggtaggacggtaagttggaacgttaggggttggtggggacgtaacgggg

SEQ ID NO: 268310 - DNA, 706 bp, Homo sapiens
  misc_feature: GYAE6OF02J1NIY.28.57.F02.1.454.CMB.1.raw
  modified_base (277)..(277): a, c, t, g, unknown or other
  misc_feature (277)..(277): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgtgctattttaaaggtgtccagtgtgaggtgcagctggtggagtctgggggagcttggtccagccgtggggggtccctgagactctcctgtgcagcctctggattccaccttcagtatttngctatgctagtcgggtcccgccagggtcctccgaaggggaacgggtactggaaagtactggtcgtacgtagggtaattaaggaagtaaagtgaccgtaaagtaaacagttataatttaataggaacctaaaacgttccggttaggtacggtaaacgggggccaaggtaactttaccaaccctaacgttccgtaacccggagggtaaacctaaacttaacccgaaacggtaaccacggtaccgttagttacttaccgttaacgaaacggttcgggactacggtaccgtagacgagacggttagaaggaccgtacggtcgtagttatacggtttaccgtagggtacgggaggtaacgggtaggtaccgggtaaaggtttacgggaaacggtttcgggggttaacgggtcgggggaacccgggttaaggggg

SEQ ID NO: 268311 - DNA, 722 bp, Homo sapiens
  misc_feature: GYAE6OF02F0MC7.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttatttttaaaggtgtccagtgtgaggtgcagctggtggagtcgtggggggaggcttggtccagccgtggggggtccctgagactctcctgtgcacgcctctggacttccaccttcagttatttatgcttatgctacgtcggggtcccgccgagggcctaccggaggggaagggtactggaatatggtctcgtaggttattaagaagtaatgaagtaataactattaatattatagactaaacttctaggtaggtacggactagtacttaccacctataccctacggaacgggtaacctaacgttaaccaaacggaaccaaccgttacttacggttaacttacccttaacgtaaagtcggggtaccaaggtacccgttagggaacggtacggtacgtacggggaacggaacccgtacgggtacgttacgtttaacgttaaggtttaccgttagggggaggtaacggggaacggggtaaggttaacggggttaaagggtttaaggggtaaaccggtttagggggggtttacggggtacgggggaccccggtaaggggggg

SEQ ID NO: 268312 - DNA, 536 bp, Homo sapiens
  misc_feature: GYAE6OF02HWU65.28.57.F02.1.454.CMB.1.raw
  modified_base (280)..(280): a, c, t, g, unknown or other
  misc_feature (280)..(280): n is a, c, g, or t
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttangtctatgcactgggtccgccaggctccgagggaagggactggaatatgtctcaggtatagaagtaatgcgaaataacatatattatgacaaactntgtagaaggcagattcacatctcaggactaataccaagaacacgctntatcttanaatgggacagcctagagagctagacggacacggtactagtatattaacgtggtagggagaggacgaggaattgggaacgttagggttggtacggggcccgaagggg

SEQ ID NO: 268313 - DNA, 591 bp, Homo sapiens
  misc_feature: GYAE6OF02IG524.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcactgggtccgccgaggctccgagggaagggactggaatatgtctcgaggtattagaagtatgacgaataacatatattatgacaaactctgtagaagggcagtacttaccaccatcgtaccgagggaactaacttaccaaacgaccacgctagtacttcttacgaaagtcgggactacggtcctaggaacgagtcgtaggaacgacgaccgggtctagtacttagttacgtgggtagggaagagggtacggacggtaagttcgggtaaggttaggggttcgggtacgggggaccgtaggggg

SEQ ID NO: 268314 - DNA, 791 bp, Homo sapiens
  misc_feature: GYAE6OF02ILBSM.28.57.F02.1.454.CMB.1.raw
  modified_base (278)..(278): a, c, t, g, unknown or other
  misc_feature (278)..(278): n is a, c, g, or t
  modified_base (418)..(418): a, c, t, g, unknown or other
  misc_feature (418)..(418): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgctattttttaaaggtgtccagtgtgaggtgcagctggtggagtcgtgggggagcttggtccagccgtgggggtccctgagactctcctgtgcagcctcgtgattcacttcagttntttatgcttgtcgctacgtgggtcccgccgtaggcctaccgaagggggaacgggactagggaattacgttgtcctacgtaaggttaagttaaggaaagttaagtggaacgtaaactaaactaagttaatttaaagtttanacgtaaacctaaacgttcgttaggtacggaaagggtctaagttaactttcccgaaacccttagtccctaacccggaaagggtaaccttaaaaccgttacccgaaagtaaaccgccggtaacctttacggttacttaccgttaaacgtaaaacggtcgggtacccgaacgtcccgttaaagggacgacggttaccgaaaggtaaccgggaaccgaacgggttccgtttaaggttaaccgtttaacgttttacgggtaacggggttaaggggaaggggtaaccggggtaaacggtaaccggggtttaaggtttaaccgggggtaaaggttttaacggggggtttcggggtacccgggggacttaacccggggggg

SEQ ID NO: 268315 - DNA, 718 bp, Homo sapiens
  misc_feature: GYAE6OF02HEGWS.28.57.F02.1.454.CMB.1.raw
  modified_base (367)..(367): a, c, t, g, unknown or other
  misc_feature (367)..(367): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattccaccttcagttattttatgctatgctactcggggtccgccaggcctaccgaggggaacgggactaggaatagtagtctactaggtattaagaaacgtanagtacgaaataacattaagttaattagtagaactaaacgttctaggtagaaagggtccaagtacttacaacctacgttaccgacccgaaagggtaaacctaaaccgttaacctaaaacggaaactaaccggtaccgtttaagttaaccttacccttaacgtaaaaaggtccggggaaccttaacgggacccttagggaaccgagggtaaccgtagggaacggaaccggaacggttaccgttagttaagttacgtttacggtaaggtaggggaagggtagggaaacggtacgggttaagttaccggggtaaaggttcgggggttaaggttcgggggaacccgtaacgggggg

SEQ ID NO: 268316 - DNA, 750 bp, Homo sapiens
  misc_feature: GYAE6OF02G4GWS.28.57.F02.1.454.CMB.1.raw
  modified_base (625)..(625): a, c, t, g, unknown or other
  misc_feature (625)..(625): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttggtccaggccgtggggggtccctggagacctctcctggtcgcacgcctctggactttccaccctttcagttatttactgtactatcgacctacggtcggggtcccgccgacggccgtaccggaagggggaacggaacgtggtaatagtcgtactacgtaaggttaagttaaaggtaaagttaagtaggaaccgtaaaattaaacgtaattaattaatttaacgtagaaccttaaactcgttaggtaaggaacgggtacaacgttaacttacccaaccgtacttaccgtaacccggaagggtaaacctaaaccgttaaccgaaaacgtaaccaacgtcttaagttactacgttaacaaggtcggacagaccgtgtaacgacgtacgtacggaaggacccgtacggtnttaacggttattaggtttaacgggtggggtaaggggtaagaccggggttaagggtaaggtaaacggtttcgggggttaaacggttaggggggtttaaccggggacggggttaccggaacgggggg

SEQ ID NO: 268317 - DNA, 631 bp, Homo sapiens
  misc_feature: GYAE6OF02IL4M5.28.57.F02.1.454.CMB.1.raw
  modified_base (282)..(282): a, c, t, g, unknown or other
  misc_feature (282)..(282): n is a, c, g, or t
  modified_base (467)..(467): a, c, t, g, unknown or other
  misc_feature (467)..(467): n is a, c, g, or t
  modified_base (517)..(517): a, c, t, g, unknown or other
  misc_feature (517)..(517): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcacttcagttatttangctatgcactgggtccgccaggcctccgaggggaggactggaatatgtctcaggtatagaagtatgcgaataacatatattatgacaaactctagtaggaagggcaaggtactttacaccctagtcctacccgaagggtaacctaaattacccaaagaaaccacgccttagtacttaccgttaanaaagtcgggacacggtcctaggaagacgacgtaggaacggactaccggtntagttaattacgtttacgtgggtacgggaaggtaacggggaagtaccgggttaaaggtttacggggtaaaccggtttaagggggttcgggtaccgggggacccgtaacgggggg

SEQ ID NO: 268318 - DNA, 622 bp, Homo sapiens
  misc_feature: GYAE6OF02J076M.28.57.F02.1.454.CMB.1.raw
  modified_base (391)..(391): a, c, t, g, unknown or other
  misc_feature (391)..(391): n is a, c, g, or t
  modified_base (415)..(415): a, c, t, g, unknown or other
  misc_feature (415)..(415): n is a, c, g, or t
  modified_base (471)..(471): a, c, t, g, unknown or other
  misc_feature (471)..(471): n is a, c, g, or t
  modified_base (505)..(505): a, c, t, g, unknown or other
  misc_feature (505)..(505): n is a, c, g, or t
  modified_base (555)..(555): a, c, t, g, unknown or other
  misc_feature (555)..(555): n is a, c, g, or t
  modified_base (614)..(614): a, c, t, g, unknown or other
  misc_feature (614)..(614): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgcttattttaaaggtgtccagtgtgaggtgcagcgtggtggagtcgtgggggaggcgttggtcccagcccgtggggggtccctgagacctcgtcctgtgcgagcctcgtggacttccacccttcaggttattttatcgtcttatgctacgttcgggtcccgccgaggcctaccgaggggaacgggacctagggaattatgtcctacgtaaggttattaaggaaagttaangtacgaaataacattaagtattanagacaaactcgtgagacgggacagtatcacgatcctacgaggactaactaccgaanaaccacgtctagtaacttctacgaagtcgggacncgtacgtgaagacgtacgtagaacgcgacgacgttatagtagtttacggngggttaggaacggtaggtacggtaggtaacggttaggaacgtttcgggtggtaccgggnggtaacgg

SEQ ID NO: 268319 - DNA, 583 bp, Homo sapiens
  misc_feature: GYAE6OF02FOYME.28.57.F02.1.454.CMB.1.raw
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtgggggggtccctgagactctcctgtgcagcctctggattcacctttcagtatttatgctatgcactgggtcccgccaggctccgaggggaacgggactaggaatagtgtctcgaggttattagaagtaatgacgaataacatatattatgacaaactntgtagaagggcagtattacacctatctaccgaggacaacttacccaaagaacacgctagtacttcttacaaagtgggacagacctagagagcgtagacggacacggtctagtatattacgtggtagggaagagggtagtacgggtaagtttacgggaaaccggttaggggtttacgggtaggggacccgtaacggggg

SEQ ID NO: 268320 - DNA, 858 bp, Homo sapiens
  misc_feature: GYAE6OF02H0VRP.28.57.F02.1.454.CMB.1.raw
  modified_base (672)..(672): a, c, t, g, unknown or other
  misc_feature (672)..(672): n is a, c, g, or t
  modified_base (832)..(832): a, c, t, g, unknown or other
  misc_feature (832)..(832): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagtccggttttcggtttcgttgtcgtacttttaaaggttttaaggtcctacgtagttggtaggtaggtcgagcgtggttggggtaggtcgttgggggtagggggcgttcggttccggtacgccggtccgggggttccggggttccgtaggacgtccttccgtcggtgtcgacgccgtccttggtagttaccttaccctaccttacgttaattttatttacggcttaacttgccgacgttacgggttcccggtcccacggtccggtaccgtaacggggaaaggggtacggtacgaaggtactacgtcgttacgtaaggttaaggttaaacgtaaaggtaaacttaggtaacggtaaagtaaaactaaattaagttaattttaagtacgtactaaaacctacgttggtaaggtaacgggaacgtactaacggttacacccgttaaactcgttaacccggaacggaaacgtaaacttaaccgtaaaccgaaacgaacgtacttacggtttacttaccgttaactaaaacggngggaaccgtacgaaccgttaggagaacgtccgtaaggacggtaacggaccgttacggttacttaagtttaacgttaggtacgggtttgggggaacggaaggggtaacggtaaccgggtaagggtttaaacgggttacgggttaacggggtttacgggggnggggtaaccccgggagggtaacccgg

SEQ ID NO: 268321 - DNA, 664 bp, Homo sapiens
  misc_feature: GYAE6OF02GMSUA.28.57.F02.1.454.CMB.1.raw
  modified_base (258)..(258): a, c, t, g, unknown or other
  misc_feature (258)..(258): n is a, c, g, or t
  modified_base (279)..(279): a, c, t, g, unknown or other
  misc_feature (279)..(279): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaatttttaaaggtgtccagtgtgaggtgcagcgtgggtggagtcgtgggggaggcttggtccagccgtggggggtccctgagactctcctgtncagcctctggattccaccttnagttatttatgtactatgctacgtcgggtcccgaccgacggtcctaccggaagggggaacgggtacgtagggtaaattcgtcgtcgtacgtaaggttaattaaggtaaagttaagtggaacgtaaataactaatattaattatacgaactaaacgttcttagggtagtaaacgggctaagtacttaccgacttactccgtacggaggtaactaaccttacgaacgaccagtctattacttactaacgaagtcgggacacgcgtagacgtagtacgtaggacgaccgtacggtacttagtaacttgtacggttgggaagggaggtaagggacggtacggtaagtttaggaacgggtttaggggtcgggtaccgggacggtacgggg

SEQ ID NO: 268322 - DNA, 558 bp, Homo sapiens
  misc_feature: GYAE6OF02JYKWD.28.57.F02.1.454.CMB.1.raw
  modified_base (282)..(282): a, c, t, g, unknown or other
  misc_feature (282)..(282): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
  modified_base (499)..(499): a, c, t, g, unknown or other
  misc_feature (499)..(499): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttgggtccagccgtggggggtccctgagactctcctgtgcagcctctggattcaccttcagttatttngtctatgcacgtgggtcccgccaggcctccgaagggaagggtactggaatatcgtcncgtaggttattagaagtaatggaacgaataanattaataatttagcgactaaactctaggtagaagggcagtatcacatctacgaggactatacaanacacnctntatactcaaagtcggcagctagaagngctagacgacgtagctgtatacgttacgngggttacggagaggaggacgtaagttagggtaacgtagggtttcggagggtccgaaggg

SEQ ID NO: 268323 - DNA, 773 bp, Homo sapiens
  misc_feature: GYAE6OF02J1WHR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggccaggccgtggggggtccctggagactctcctgtcgcagcctctggattccaccttcagttactttatgctagtgcacgttcggtcccgcgacggtccttacccggaggggaaacgggtaccgtaggtaagttacgttcgtcctaccgtaagggttaagttaaggaaagttaaagtacggaccgtaaaattaaccgaattaattaattaactgaacctaaaacttcgtaggtaaggaacgggtactagtactttaccgaaccttacgtacctacccggaaggtaacctaacgttaacccgaaacgtaacgaccgtactacggttactaccgttaacgtaaacggtcgggtaactacgacccgttaacggaacgtaccggtacgtacgggtaaccggaaccgtaacgggtccgttaaggttaacttacggtttaaccggtaggggttaacggggtaacggtaagggggtaaccggttaggggtaaacggtttaccggggtaaacgggtttacgggggttaaccgggttacgggggtaacccgggttaaaccggggg

SEQ ID NO: 268324 - DNA, 575 bp, Homo sapiens
  misc_feature: GYAE6OF02H6LZY.28.57.F02.1.454.CMB.1.raw
  modified_base (179)..(179): a, c, t, g, unknown or other
  misc_feature (179)..(179): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (509)..(509): a, c, t, g, unknown or other
  misc_feature (509)..(509): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttaattttttaaaggntccagtgtgaggtgcagctggtggagtcgtgggggagcttggtccagccgtggggggtccctgagactctcctgtgcagcctcgtggattccaccttcagttatttangctatgcacgtggtcccncctaggcctaccgagggaacgggactaggaatagtgtctacgtaggtaatagaaagtatgacgaaataacattatatatgactaatctgtagaaggtcagtactacactatcacgaggactaactacaagaacactntactatcttaanaaacgtggactagcctagacgagcgtagacggacacgtcgtatacttagttacgngggtaggaaggtaggacgtacggtaagttaggaaccgttaggggtagtacggggaccgtaacgggg

SEQ ID NO: 268325 - DNA, 844 bp, Homo sapiens
  misc_feature: GYAE6OF02GMYSH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcacctgcacacagaagagtcatgacggtagtttgggctgagcgttgggttttccttgttgcttaatttttaaaggtcgtccagtgtggaggtgcagcgtggtggagttcggtggggggaggtcgtttcggtccaggcccgggttcggggggttcccctggagtaccttccgttccgttggtcgaccacggtcctcggttggtactttccctacccgtttcaagtttattttagtcgtcttaatgacctaccggttcgggtccccgacgtacgggtcctaccggaagggggaacgggacgtaggtaaattcgtgttccgtacgtaaggttaattaaggaaagttatacggaacgtaaataaactaatttaactttaagttagtacgtaacctaaaacgttcttaagggtaggaaacgggtacgtaacgtacgtttaccacctactaccgtaccggtaacggtaactaaccgttaaccgaaacgtaaaccgtaccgtaacgttacgtttaaccttaccgttaacgtaaacgttcggggtaacctaaccggtaccggttacggaacgggtacgtacggttaccgggaaacggtaaccggtaaccgggtaccgtttaacgttagttaacggtttaccggtaagggttaaggggtaacgggaagggtaacgggtacggttaaacgggttagggttaaaccgggtttaggggttacggggttaccgggggtacggtaaccggggg

SEQ ID NO: 268326 - DNA, 630 bp, Homo sapiens
  misc_feature: GYAE6OF02FVTPB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgctacgtgggtcccgccgaggctcccgaaggggaacgggactagggaattagtgtctcgagggttattagaagtaatgacgtaataactataattaattatagactaaacttctaggtaggaagggacagtacttacacctatacctaccgaagggaactaacttaccaaacgaaccacgactagtattaccgttactaaacgtcgggacacgtaccgtgaggacgcgtaggaacggaccgaggtccttagtattacgtttacgtgggtagggtaaggagggacggtacggtaaggttacgggtaacggttaggggttaggtacgggggtacggtaacgggg

SEQ ID NO: 268327 - DNA, 622 bp, Homo sapiens
  misc_feature: GYAE6OF02FX2YQ.28.57.F02.1.454.CMB.1.raw
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagcccgtggggggtccctgagactctcctgtgcagcctctggattcaccttcagttatttatgctatgctacgtgggtcccgccgaggcctccgaggggaacgggacgtggaatgtgtctcgaggtattagaagtatgacgaataacatatattatnactaaatctagtagaaggcagtattacacctatccaccgagggaactaacttaccaaagaaccacgtactagttacttacttacgaaagttcgggactacgcctgagacgtcgtaggaacggaccgacggtcttaggttacttacgtttacggttgggtacggggtaaggtaacgggtagggtacgggtaagttacgggtaaccggttagggggttacgggtcgggggaccggtaacggggg

SEQ ID NO: 268328 - DNA, 849 bp, Homo sapiens
  misc_feature: GYAE6OF02F424B.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacgggagtttgggctgagctgggttttccttgttgcttatttttaaaggtgtccagtgtgaggtgcagctggtggagtcgtgggggaggtcgttggtccagccgtggggggtccctgacgtactcctcctgtcgcacgtcctcgtggtacttcctaccttctaagttattttactgtactagtcgacctacggtcggggtcccgaccgacgggtcctaccggaagggggtaagggacgtaggtaattagttcgtacgttacgtaggttaacgtaagtaaacgttaagtacgtagtaaaactaaactaagttaatttaattaagtacgtaacctaacttacgttaggtaaggtaacggtacgtaacgtaaccttaccgaaaccctacgttaccgtaacccgggtaacggaaacccttaaacgttaacccgaaaacggtaaaccctacggttaccgttaactttaccgttaaccctttaaacggaaacggttaccggggaactaaccggtcccgtaaggtaaccgggtactaccggggttaaagaaaccgggaacccgttaaccgggtacgttaaccgttttaagtttaccggtttaaggttgggggtaaaccggggagggttaaaaccggggtacgggtaagggtttaacggggtttaacgggttaaaccgggggtttagggggtttaacccgggttcggggggaacccggttaaccggggg

SEQ ID NO: 268329 - DNA, 602 bp, Homo sapiens
  misc_feature: GYAE6OF02FPX8K.28.57.F02.1.454.CMB.1.raw
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccaggccgtgggggggtccctgagactctcctgtgcagcctctggattcaccttcagttatttatgctatgcacgtgggtccgccaggcctccgaggggaagggactggaatatgtctcgaggtattaggaagtaatgacgtaaataacatatattatgacaaactntgtgaagggnagattcacatctccgaggacaacttaccaaagaaccacgtactagttactacttacaaagtcgggacagcctagacgagtctaggaaggaaccgacgggtcttagtacttacgtttaacggtgggtaggggtaggtaagggacggtaacgggtaaggtttcgggtaaacggttaggggtttagggtcgggggaccgtaacgggggg

SEQ ID NO: 268330 - DNA, 528 bp, Homo sapiens
  misc_feature: GYAE6OF02HSM8E.28.57.F02.1.454.CMB.1.raw
  modified_base (298)..(298): a, c, t, g, unknown or other
  misc_feature (298)..(298): n is a, c, g, or t
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccctgagactctcctgtgcagcctctggattcaccttcagtatttatgctatgcactgggtccnccaggctccgagggaagggactggaatatgtctcaggtattagaagtaatgacgaataacatatattangacaaactctagtgaagggcagattcacatctcaggacaatcaagaacacgctgatctacaaatggnacgccngagagctgacggacacggctagtactattacgtggtgggagaggagacggtaagttggaacgttaggggtggtacggggcgaacgggg

SEQ ID NO: 268331 - DNA, 650 bp, Homo sapiens
  misc_feature: GYAE6OF02IQO2W.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccaggccgtgggggggtcccctggagactctcctgtgcagcctctggattcaccttcagtatttatgctatgcacgtgggtcccgcaggcctccgagggaagggactggaatatgtctcgagtattagaagtatgacgaaataacatattattatgactaaacttctggtaggaagggcaggtacttaccaacctattacccgtaccgaagggaacctaaacgttaacccaaaggaaaccctaacggcctttagttaactttcctttaacgaaaacgttggggaccaacgtccgtaggaacggtacgacgtaggaacgggaacctacgggcttaggttaactacgtttaacgtggggtagggaagggtaggacggtacgggtaagttagggtaacggttagggggttcgggacggggtaccggtaacgggg

SEQ ID NO: 268332 - DNA, 665 bp, Homo sapiens
  misc_feature: GYAE6OF02IVLDK.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccaggccgtggggggtccctgacgactctccgtgtgcagcctcgtggacttccaccttcgagttactttatgtactatcgctacgtcggggtcccgaccgaggcctccggaaggggacgggtacgtagggaattatcgtcgtacgtaggttacttaaggaagtaagtagacgtaaactaactataattaattatagaactaaacttcgtaggtaggaacgggtcaagtacgttaccaacctctacccgtacgaacggtaactaacgttaccgaagtaacctaacgcgttacgttacttacctagtaacgtgacgtacgcgtagagtacgtcgtaagacggactaacggtcgtagtattacgttaggtcggtagggaaggacgggtaacgacggttaagttacggaaccgggttaggggttacggtacggggaccgtaacgggg

SEQ ID NO: 268333 - DNA, 593 bp, Homo sapiens
  misc_feature: GYAE6OF02GXYC7.28.57.F02.1.454.CMB.1.raw
  modified_base (322)..(322): a, c, t, g, unknown or other
  misc_feature (322)..(322): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtccgcaggctccagggacggctggaatntgtctcaggtattagaagtatgacgaataacatatattatgacaaactctggtagaacgggcagtacttcaacctatctaccgagggaactaacttaccaaagaacacgctagtactcttacaaagtgggactacggcctggacgagcgttagacggacacggcttagtacttagttacgtgggtaggggtaacggagggtaacggtacgggtaagtttacggggaaaccgtttaggggggttacgggtacggggggaccgtaacgggggg

SEQ ID NO: 268334 - DNA, 553 bp, Homo sapiens
  misc_feature: GYAE6OF02GP8MP.28.57.F02.1.454.CMB.1.raw
  modified_base (297)..(297): a, c, t, g, unknown or other
  misc_feature (297)..(297): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtgagtcgtgggggagcttggtccagccgtggggggtccctgagactctcctgtgcagcctctggattcaccttcagttatttatgcttatgcactgggtccnccaggctccgagggaaggactggaatatgtctcagtatagaagtatgacaataacataattattatagactaaactctagtagaagggcagtattcgaccatcgtccgaggacaattaccaacgaacacgctagtactcttaacaaatgggacagtcctaggagacgcgtgaacgtacacggtctagtacttattacgtgtagggacgaggacggtacggagttcggtaacgttagggtggtcgggcggtaacggg

SEQ ID NO: 268335 - DNA, 609 bp, Homo sapiens
  misc_feature: GYAE6OF02G3TCA.28.57.F02.1.454.CMB.1.raw
  modified_base (486)..(486): a, c, t, g, unknown or other
  misc_feature (486)..(486): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcaccttcagttatttatgtctatgcactcgggtccgccaggcctccgaggggaggactaggaatagtgtctcgtaggttattaagaagtaatgacgaataacatatattatgactaacttctaggtagaagggcagtattccacctatcctaccgaagggtaactacgttaaccaaacgaacacgtctagttacttactacaaagtcggacacggtccnggaagtcgcgtacgaaggaccgaacgtcgttacgtattagttaccggtgggtacgggaaggagggtacggaggtaaggttcgggtaaccggttgggggtttacggtaggggaccggtacgggg

SEQ ID NO: 268336 - DNA, 630 bp, Homo sapiens
  misc_feature: GYAE6OF02GC8GN.28.57.F02.1.454.CMB.1.raw
  modified_base (381)..(381): a, c, t, g, unknown or other
  misc_feature (381)..(381): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgctacgtgggtccgccaggcctccgagggaagggactggaatatgtctcaggtattagaagtatgacgaataacatataattatgacaaactntagtaggaagggtcagtacttacacctattcccgtaccgaacgggtacctaaacgttacccaaagaaaccaccggtactagttacttaccttacgaaacgttcggggactaacggcctaggaagacggtctagggaacggacgacgggtactagttattacgttacggtggtagggaggaagggacggacgggttaaggttacgggaacggttagggggtttacgggtacgggggtaccgtaacggggg

SEQ ID NO: 268337 - DNA, 626 bp, Homo sapiens
  misc_feature: GYAE6OF02I0NEZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggagcttgggtccagccgtggggggtccctgagactctcctgtgcagcctctggattcaccttcagttatttatgctatgcactggtccgcaggctccgagggaagggactggaatgtgtctgagtattagaatagtgacgaataacattatattatgacaaactctgtagaaggcagtacttcacatctcgagggactaacttacgaaacgaccacggacttgtaacttccgtaacaaagtcgggacacgtcctaggaagtacggcgtacggaagggacctacgggtacttagttacgttactttaaccgggttggttaacggggaggtacgggttaagggtaaccgggttaaaggtttacgggttaaacgggttagggggtttacgggttaccggggggtacccgtaaacgggggg

SEQ ID NO: 268338 - DNA, 580 bp, Homo sapiens
  misc_feature: GYAE6OF02HOCC5.28.57.F02.1.454.CMB.1.raw
  modified_base (282)..(282): a, c, t, g, unknown or other
  misc_feature (282)..(282): n is a, c, g, or t
  modified_base (350)..(350): a, c, t, g, unknown or other
  misc_feature (350)..(350): n is a, c, g, or t
  modified_base (380)..(380): a, c, t, g, unknown or other
  misc_feature (380)..(380): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattcaccttcagttatttangctatgcactgggtcccgccaggctccgaggggaacggactggaatatgtctcgaggtattagaatangacgtaataacatatattatgactaaactntgtagaagggcagtataccactatcctaccgagggacaacttaccaaagaaccacgtactagtacttcgttacaaagtcgggacagccgtagagagcgtaggaacggacacggcttagtattacgtttacgtgggtagggaggtaggaggacggttaagtacgggtaacgttagggggttcggtaggggacgtacggggg

SEQ ID NO: 268339 - DNA, 740 bp, Homo sapiens
  misc_feature: GYAE6OF02I393X.28.57.F02.1.454.CMB.1.raw
  modified_base (262)..(262): a, c, t, g, unknown or other
  misc_feature (262)..(262): n is a, c, g, or t
  modified_base (534)..(534): a, c, t, g, unknown or other
  misc_feature (534)..(534): n is a, c, g, or t
  modified_base (599)..(599): a, c, t, g, unknown or other
  misc_feature (599)..(599): n is a, c, g, or t
  modified_base (657)..(657): a, c, t, g, unknown or other
  misc_feature (657)..(657): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttaatttttaaaggtgtccagtgttgaggtgcagctggtggagtcggtgggggagcgttcggtccgagccgtgggggtccctgagactctcctgtcgcncgcctctaggacttctaccttcagttactttatgtcctagtgacctacgtcgggtcccgccgtagggcctaccggaagggtaagggactaggaatagtcgtctacgtaggttaagttaaggaaagtaagtacggaacgtaaagtaacctaagttaacgtttaattaagtacgtaactaaactcggtagttacggaacgggtactagtacgttaccctaactaactccccgttacggtaaacggaactaacttaaacccggaaagtaaacccncggttacttaggttaactaccgttaaacgtagtcggtaccggtaagttaccgacgacgggtaccngttacgacggaaacccgtacgttacgttagtacttaacggttaggtcggggtaagggnggtaacgggtagggtaaaccgttagggtttaacgggtaagggtttcgggggttacgggtacccgggggtacggtaacccgggg

SEQ ID NO: 268340 - DNA, 779 bp, Homo sapiens
  misc_feature: GYAE6OF02FUJU9.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggaggcttggtccaggccgttggggggtccctggacgactctccgtgtgcagcctctggattccacctttcagttatttatgtctatgcacgtcgggtcccgccgaggtcctccggaaggggtaacgggacgttaggaattacgttgtcttacgaaggtttaattaaggtaaaggtaagtcggtaacgtaaagtaactaattaatttattaagtcgtaaacgtaaaacttcggttaggttaacgggaacgggtcgtaacggtacttttaaccccaacgtacttcccgtaacccggaacgggtaacctaaacgtttaaccccgaaacgtaaacccgtaaccggttacttaacggttactttaccgttaaacgaaacggttccggggactaaacggtcccgttaagggaacggtacgtacttaggggaaccggtaaccggtaacggtccgtttaaggttacttacggtttaccggttagggtaacggggtaaggacggggttaacgacgggtttaaaggttacgggttaaacgggtttggggtttacgggtaccggggtaccggtaacggggg

SEQ ID NO: 268341 - DNA, 502 bp, Homo sapiens
  misc_feature: GYAE6OF02F3ZF9.28.57.F02.1.454.CMB.1.raw
  modified_base (412)..(412): a, c, t, g, unknown or other
  misc_feature (412)..(412): n is a, c, g, or t
  modified_base (423)..(423): a, c, t, g, unknown or other
  misc_feature (423)..(423): n is a, c, g, or t
  modified_base (499)..(502): a, c, t, g, unknown or other
  misc_feature (499)..(502): n is a, c, g, or t
tcagagtacgctatcacgaccggtgctcgatttagctcgatatagttgggtttgggggtcccgtgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtgggagaggagcggaattggaactaggggttgtggggccagggagccctggtcaccgtctcctcagcctcaccaagggcccatcggtcttcccctggcgccctgctccaggacncacctccgagngcacagcgccctgggctgcctggtcaaggactacttccatacgcgtactctgagcgggctcggcaaggcgcatagnnnn

SEQ ID NO: 268342 - DNA, 693 bp, Homo sapiens
  misc_feature: GYAE6OF02F1RQD.28.57.F02.1.454.CMB.1.raw
  modified_base (272)..(272): a, c, t, g, unknown or other
  misc_feature (272)..(272): n is a, c, g, or t
  modified_base (390)..(390): a, c, t, g, unknown or other
  misc_feature (390)..(390): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttnagtatttatgtctatgcacgtgggtcccgccgaggcctcccgaaggggaacgggactaggaattagtgtctacgaggttattaaggaagtaatggacgtaaataacattaattattancgactaaacttcgtagtaggaacgggtacagtattaccgacctaatccctacggaacgggtaactaacgttacccaaacgaaccacgtaccttacgttacgttaccttaacgaaagttcgggactaacggacccgtaggtaaggacgtaccgtagggaacgggaaccgtaccgggtacttacggttagttaacgtttaccggttagggtaggggacgggtaagggtacggaacggggttaacggttacggggtaaacgggtttaggggtttacgggggtaccggggacccgggtaacgggggg

SEQ ID NO: 268343 - DNA, 800 bp, Homo sapiens
  misc_feature: GYAE6OF02G7JKZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggcccctgagcgtggttttccttgttgctattttaaaggtgtccagtgtgaggtgcagcgtgggtggagtcgtgggggaggtcgttggtccgagccgtggggggtccctgagactctcctgtgcacgctctggattcctaccttcagttatttatgtctatcgctacgtcgggtcccgccgacggtccgtaccgaaggggaacggacgtaggtaatagtcgtaccgtacgtaaggttaagttaaggtaaagtaagtacgaacgtaaataaacctaattaagttaattacgtagtaacctaaacttcgtaggtaggtaacgggactaacggtactaccgtaacctagttaccccgtaccggtaagggtaaaccctaacgttaaacccgaaaacgtaaacccgtaaccggttacgtttacggtaacttttacccgtaaacgttaaagggtaccgggtaccaccgggtaccgtacgggtaagtaccgggtacgtaacgggtaaacggaccgtaaccgggtaccgttaaggttaaccgttaagttttaacgggtgggtaacggggtaaggggtacggggtaacggtacggggttaaacgggtttaccgggtaaaagggggttttcgggggtacggggttaccggggggaccgttaaccccggggggg

SEQ ID NO: 268344 - DNA, 624 bp, Homo sapiens
  misc_feature: GYAE6OF02GBG8C.28.57.F02.1.454.CMB.1.raw
  modified_base (147)..(147): a, c, t, g, unknown or other
  misc_feature (147)..(147): n is a, c, g, or t
  modified_base (163)..(163): a, c, t, g, unknown or other
  misc_feature (163)..(163): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgnggtttcgtgtaggctntttaaagtgtcagtgtgaggtgcagctggtggagtctgggggaggcttggtccagcccgtgggggggtccctgacgactctcctgtgcagcctctggattcacctttcagttatttaatgctaatgcactgggtccgccaggctccgagggaacgggagtggatagtgtactcgtaggtattagaagtatgtacgaataacatatagttatgacaaacctntagtggaacgggtanacgtacttaccacctagtaccctaccggaacggtaacctaacttaccgaaacgaccgtaacgtctagttacttacttaagaagtcgggactacggacgtagagagtcgtagggaacgtacggacgtcgttaggttactacgttaggtagggtagggtaggaggacggtaacgggtaaggttacggggtaaccggttagggggttcggacgggggtaccgaagggg

SEQ ID NO: 268345 - DNA, 594 bp, Homo sapiens
  misc_feature: GYAE6OF02GE2TH.28.57.F02.1.454.CMB.1.raw
  modified_base (272)..(272): a, c, t, g, unknown or other
  misc_feature (272)..(272): n is a, c, g, or t
  modified_base (417)..(417): a, c, t, g, unknown or other
  misc_feature (417)..(417): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttnagtatttatgctatgcactgggtccgccaggctccaggggaaggactgggaatatggtctcgaggtattagaagttatgacgaataacatatattatgacaaactctgtgaaggcagtatcacatctcaggacaattccaagacncgctgtactcttacaaagtgggacacgcctaggacgagcgttagacggaccgacgggtcttaggtactaacgtttaccgttgggtacggggtaacggaaggggtaacgtaccggggtaaatttcggggaaaccggtttaggggggtttcgggtaccggggggacccgtaacgggggg

SEQ ID NO: 268346 - DNA, 521 bp, Homo sapiens
  misc_feature: GYAE6OF02I853E.28.57.F02.1.454.CMB.1.raw
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcacgtgggtcccgccaggcctccgaggggaggactggaatatgtctcaggtattagaagtatgacgaataacatatattangactaaactntgtagaagggcagtattcacatcctccgaggacaattaccaagaccacgctagtatctacaaatgggacagcctgangctgagacncgctagtatatacgtggtaggagaggngaggtagttggagtgggtgtagggcgtaggg

SEQ ID NO: 268347 - DNA, 678 bp, Homo sapiens
  misc_feature: GYAE6OF02G682R.28.57.F02.1.454.CMB.1.raw
  modified_base (308)..(308): a, c, t, g, unknown or other
  misc_feature (308)..(308): n is a, c, g, or t
  modified_base (583)..(583): a, c, t, g, unknown or other
  misc_feature (583)..(583): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattccaccttcaagttattttatgtctatgcacgtcgggtcccnccgaggcctccggagggacggactggaatagtgtctcgtaggttattaaggaagtaagtgaacgtaaataactattaattatttaatagtaaccctaaaactttcgtagggttaacggaaggggtactaaggtactttacccaacctaacttcccgtaccggaacggtaacctaacttaacccgaaagaaccgaccgtacttagttaacttaccgttaacgaaagttcgggacctacggtcctaggtagacgtaccgtaggaccggacgacggtnttagtattagttacggtgggtagggaaggtacggtaggtaccggtaaggttacgggtaacggttagggggtcgggttaggggaccgtaacggggg

SEQ ID NO: 268348 - DNA, 642 bp, Homo sapiens
  misc_feature: GYAE6OF02II7ZZ.28.57.F02.1.454.CMB.1.raw
  modified_base (175)..(175): a, c, t, g, unknown or other
  misc_feature (175)..(175): n is a, c, g, or t
  modified_base (570)..(570): a, c, t, g, unknown or other
  misc_feature (570)..(570): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtcgtggggggaggcttgggtccaggccgtgggggggtccctgagactctcctgtgcagccctcgtggacttccacctttcaagttattttatgctatgctacgtgggtcccgccaggcctccggaggggaagggactggaatatgtctcgaggttattaggaagtatgacgaaataacatattattagtgactaaacttcgtaggtagaagggcaaggtactttcaaccctagttccctaccggaagggtaacctaaacttacccgaaagaaaccaccgtacttagtaattaccttaacgaaagtcgggacacggtcctagaagtacgcgtaggaacggtacacgggtcttagttactagtttacggngggttacgggagtaagggtacgacggttaagttacgggaacgttaggggttggtacggggacgtaacggggg

SEQ ID NO: 268349 - DNA, 613 bp, Homo sapiens
  misc_feature: GYAE6OF02IGOF1.28.57.F02.1.454.CMB.1.raw
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattcaccttcagtatttangctatgcacgtgggtccnccgaggctccgagggaagggctaggaatatgtctcaggtattagaagtaatgacgaataacatattattatgacaaactctaggtagaagggcaagtattcaacctatcctacgagggactaacttaccgaaagaccaacgcgttagtaacttcttacgaaagtcgggacaacggtcccgttagaacggtacgcgttaggaacggtacgaccgggtacttagtacttaagtttacgtagggtagggagacgggtagacgggttaagttagggaaccggttagggggtttacggcgggggtaccgtacggggg

SEQ ID NO: 268350 - DNA, 673 bp, Homo sapiens
  misc_feature: GYAE6OF02HVSWS.28.57.F02.1.454.CMB.1.raw
  modified_base (373)..(373): a, c, t, g, unknown or other
  misc_feature (373)..(373): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgtctatgcacgtgggtccgccaggctccgaggggagggactaggaatatgtctgagtattagaagtaatgacgaataacataatattanagacaactctagtaggaagggcagtacttaccaacctatccgtacgagggtaactaacgtaccaaagaaccacgtacttagttaactccgttaacgaaacggttgggactacggtacccgtaggaacgacggtacgtacgggaacggaaccgtacgggtactttaaggttaacttttacggttaacggttggggttaacggggaagggtaacggggtacggtaaccggggttaaaggtttacgggggtaaaccgggtttaggggggtttaggggtaccgggggtacccggtaacgggggg

SEQ ID NO: 268351 - DNA, 562 bp, Homo sapiens
  misc_feature: GYAE6OF02HQGGQ.28.57.F02.1.454.CMB.1.raw
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
  modified_base (425)..(425): a, c, t, g, unknown or other
  misc_feature (425)..(425): n is a, c, g, or t
  modified_base (478)..(478): a, c, t, g, unknown or other
  misc_feature (478)..(478): n is a, c, g, or t
  modified_base (484)..(484): a, c, t, g, unknown or other
  misc_feature (484)..(484): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (502)..(502): a, c, t, g, unknown or other
  misc_feature (502)..(502): n is a, c, g, or t
  modified_base (511)..(511): a, c, t, g, unknown or other
  misc_feature (511)..(511): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttttaaaggtgtccagtgtgaggtgcagctggtggagtctgggggagcgttggtccagccgtggggggtccctgagactctcctgtgcagcctctggattcaccttcagttatttatgctatgctacgtcgggtcccnccgaggcctaccgaagggggaaggcctagggaatgtgtctagacggttattaaggaagttaatgacgaaataaacattaatattanacgactaaactctgagaagggcagtattccactancctcgaggaactacttccaaacgacacgtcttagacttcttacaagtcggganacgtcngagngntgaagcacgctntatattcgnggagaggaggagtaggtagttagggaactggggttgcggggacgtacgggg

SEQ ID NO: 268352 - DNA, 715 bp, Homo sapiens
  misc_feature: GYAE6OF02FYMCX.28.57.F02.1.454.CMB.1.raw
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtccctgagactctcctgtgcagcctctggacttccacctttcagttatttagtgtctatgcacgtcgggtcccgccgaggcctaccggaaggggaaggactaggaatagtcgtctcgtaaggtattaagaatatgacgaataanatatatanagactaactcgtagtaggaaggctagtacttacgacctataccgtacgaaggtaacctaaacgttacccaaaagtaacctacgaccttagttaacttccgttaacgtaaagtcggggactacggtaccgtagggaacgtacggtaccgttaagggaacggtaaaccgtacgggtacgtttaaggttaacgtttaacggttaccggttaggggtaacgggggttaacggggaacggggtaacgggttaacggggttaaagggtttacggggttaaaaccggggttttagggggtttcggggttaccggggggtaccccggtaacggggggg

SEQ ID NO: 268353 - DNA, 650 bp, Homo sapiens
  misc_feature: GYAE6OF02GVQSH.28.57.F02.1.454.CMB.1.raw
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttggggtctgggagacggagcccccgccctggggtttcccaggtgttctcatttcggtgatcagcactgcacacagaagagtcatgacggagtttgggctgagctgggttttccttgttgctattttaaaggtgtccagtgtgaggtgcagctggtggagtcgtgggggaggcttggtccagccgtggggggtacctgagactctcctgtgcagcctcgtggattcaccttcagttatttatgctatgctacgtggtccncgtaggcctccgagggaagggctaggaatgtgtctgagtatagaagtaatgacgaaatacgatatattanagactaaactctggtaggaagggacagtattccgacctattccgacgaacgggtactaacgttaccaaaaggaccacggtacttagttactaccttaacaaaggttcgggacctggtaccctagggacgacgtacgtacggaaacggtaccgaacggtcttaagtaacttaacggttacggtgggttacgggaagtaccggggtaaggtaacgggttaaggttacgggaaaccgggtttagggggttacgggtacgggggtacccgtaagggggg

SEQ ID NO: 268354 - DNA, 641 bp, Homo sapiens
  misc_feature: GYAE6OF02IWGZ0.28.57.F02.1.454.CMB.1.raw
  modified_base (347)..(347): a, c, t, g, unknown or other
  misc_feature (347)..(347): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctccgtgtgcagcctctggattcgaccttcagttatttatgctatgcagtggtcccgcaggctccgagggaggctaggatatgtcagaggtatagaagtangacgaataacatatattatgactaacttctagtagaacgggcagtacttaccactatccgtacgaaggtactaagttaccgaaagaaccaccggtactagttactaccgtttaacaaagttggggacctaacggtcccgttaggaaccggtgtaccgttggaaacgggtaccgaaccgggtacttagtacgttaacgtttaacggtgggttaggggaagagggtacgggtaacggtaacggtttaacggaaccgggtttaaggggttcggggtaccggggtacggtaacggggg

SEQ ID NO: 268355 - DNA, 642 bp, Homo sapiens
  misc_feature: GYAE6OF02JEVFC.28.57.F02.1.454.CMB.1.raw
  modified_base (300)..(300): a, c, t, g, unknown or other
  misc_feature (300)..(300): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtgagtcgtgggggagcttggtccagccgtgggggtccctgagactctcctgtgcagcctctggattccgaccttcagttatttatgctatgcacgtggtccncgaggctcgagggacggactggaatgtgtctcgagttagttaagaagtagtgacgaaataacattaagtattagngtactaaagtcgtaggtagaacgggctagtacttccgacctagtcctacggaaggactaacgttaccgaaagaccgacgtccgttagtttaacctcgttaacgaaagtcgggactacggtacccgtagaagacggtaccgttaggaacggtaacccgcgggtaactttacgggtatttacgttacggttagggtacggggagtaacgggcggtaacggtaaggttaccggttaaggttaggggtttaggaccggggtacgtacgggg

SEQ ID NO: 268356 - DNA, 615 bp, Homo sapiens
  misc_feature: GYAE6OF02GL336.28.57.F02.1.454.CMB.1.raw
  modified_base (300)..(300): a, c, t, g, unknown or other
  misc_feature (300)..(300): n is a, c, g, or t
  modified_base (392)..(392): a, c, t, g, unknown or other
  misc_feature (392)..(392): n is a, c, g, or t
  modified_base (415)..(415): a, c, t, g, unknown or other
  misc_feature (415)..(415): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgctatttttaaaggtgtccagtgtgaggtgcagctggtggagtctgggggaggcttggtccagccgtggggggtccctgagactctcctgtgcagcctctggacttcaccttcagttatttatgctatgcacgtgggtccncgaggcctccggagggtaagggactggaatagtgtctacgtaggttaataggtaagtaagtgacgtaaataacaatatattatgactaactntggagtaagggcagtattcactntccgtcgaggactaacgttacaaacgacacgctagtactcttaacgaagtcgggacaacgtccgttagagacggtctaagacgggtaacacgggtatacgttattaactacgttcgggtaggtaacgggtaggtaacgggtaggtaacggttagggtaaaccggttaggggtttacgggcggggtacccgtaacgggggg

SEQ ID NO: 268357 - DNA, 722 bp, Homo sapiens
  misc_feature: GYAE6OF02HMGIY.28.57.F02.1.454.CMB.1.raw
  modified_base (285)..(285): a, c, t, g, unknown or other
  misc_feature (285)..(285): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtgcagcctgtggattccaccttcagttatttangctatgctagtcgggtccncaggcctcggaagggaggtactggaatacgtgtctagtagggttattaaggaagttagtcgaagtaaactaaacgtaattaattaacgttatacgtaacaaaaccgtttgtagggtaggaaacggggactaacggttaacttacctaacccgtaacgttacccgtaaccggtaacgggtaaacctaaacgttaacccgaaaacggaaaccgtaaccgtaccgtttagtaacttaccgttaaaccgtaaagggtcgggtaaccgtaacggtcccttaaaggacgtaacggtacgttagggaaccgggaaacgtaccgggacttagtaattacgttacggtaggtagggagggtaacggaaggtacggtaagttaacggtaacgggttagggtttacggggacgggtacccgtaaggggg

SEQ ID NO: 268358 - DNA, 931 bp, Homo sapiens
  misc_feature: GYAE6OF02G5FWF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggaggcttggtccagccgtggggggtccctgagactctcctgtgcagcctcgtggattccaccttcagttatttatgtctatgcacgttcggggtcccgaccgtaggcctacccggaaggggaacggggacctaggggaaattacgttggtccttacggtaagggttaagtttaaggtaaaggttaagttacggaaccggtaaaaagtttaaacctaatttaaattaacgttttaacgtacggtaacccttaaaaacgtttccgttaggtaacgggtaaacggggtaccgttaacggtaactttacccctaaacccgtaacgttaccccgttaacccgggaaacggggttaaaccttaaaacccgtttaacccgaaaaacggtaaaacccgtacccgttaaccggtttaagtttaaacctttaacccgttttaacgtaaaaacgggttcgggggtaacccctaaccgggttacccttaaggggtaaccgtaacgggtacccgttaaacggggaaccgggtaaccccggttaaaccggggttctttaacgggtttaacgttttaacggtttttaacccgggtagggggtttaaccggggaaggggttaaacgggggtaacggggttaaccggggttaaacgggtttacggggttaaaacccggggttttaaggggggtttttccgggggtaaccgggggggttaaccccggttaacgggggggg

SEQ ID NO: 268359 - DNA, 539 bp, Homo sapiens
  misc_feature: GYAE6OF02GFZXZ.28.57.F02.1.454.CMB.1.raw
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
  modified_base (435)..(435): a, c, t, g, unknown or other
  misc_feature (435)..(435): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccaggctccgagggaagggactggaatatgtctcgaggtattagaagtaatgacgaataacatatattatgacaaactntagtgaagggcagattcaccatctacaggacaactaccaagaacacgntagtatcttanaatggcagctgagagcgtagaggacaggctagtatattacgtggtgggaggaggagacggtaagttagggaacgttaggggttggtacggggacgtaacggggg

SEQ ID NO: 268360 - DNA, 718 bp, Homo sapiens
  misc_feature: GYAE6OF02JA7NV.28.57.F02.1.454.CMB.1.raw
  modified_base (225)..(225): a, c, t, g, unknown or other
  misc_feature (225)..(225): n is a, c, g, or t
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttccttgttgctatttttaaaggtgtccagtgtgaggtgcagctggtggagtcggtgggggaggcgttggtccnggccgtggggggtccctggagctctccgtgtgcngcctcgtggacttccgtaccttcagttattttagngtacttatgtcgaccgtggggtccctaccggacggcctacccggaggggaacggtacgtaggtaatacgttggtcgttagagggttacgttaaggaagttaagtacggaacgtaaaactaactaattataagttanacgtaaactaaacttgtcggtaagaaccgggtataaggtactaccaacgacgttaccgtaccggaaggtaactaaacgttaacccgaaaggtaaaccctccgtaacggtttctaacgtttccttaaaccgtaaaggtccgggtaccaaacggttcccgtaggaaacggttacgcgttaaaggccgtaacgggagtaccgttagttacgtaagttcggtaacggtggaacgggtgacggttaagggtaatacggggtacggttggggttacggtcgggacggtaacggg

SEQ ID NO: 268361 - DNA, 672 bp, Homo sapiens
  misc_feature: GYAE6OF02HSER5.28.57.F02.1.454.CMB.1.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggaggcttggtccagcctggggggtccctgagactctcctgtgcagcctcgtggattccaccttcagttntttangctatgcacgtcgggtccgccaggcctccggagggaagggtctggaatatgtctcgaggttatagaagtatgacgtaaataacataattaacttatgactaaacttctaggtaggaacgggcaagtacttaccaaccctactacctacccggtaagggaacctaaacgttacccgaaacgaaaccgtaaccggtcctttacgttactttacccgttaacgtaaacgtcggggtaacacggtacctaggaacgtacgcgttacgggaggtaacccgacggtcgttagttacttagtttaccggtggtaaggggagtagggaacggtacgggtaaggtttacgggaaaccggttttagggggttacggtacggggtacgtaacccgggg

SEQ ID NO: 268362 - DNA, 685 bp, Homo sapiens
  misc_feature: GYAE6OF02IW5E6.28.57.F02.1.454.CMB.1.raw
  modified_base (272)..(272): a, c, t, g, unknown or other
  misc_feature (272)..(272): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagcctggggggtccctgagactctcctgtgcagcctctggattcacccttnacgttattatgctatgcactggtcccgcaggctccgagggaaggctaggaatatgtctcaggtattagaagtatgcgaaataacatagtattagtacgactaaactcgtagtaggaacgggcaaggattaccaccgtacttccgtacccgtaagggaacctaaacgtttaccgaaacgtaaccgaaaccgttcgttacggtttaacttaccgttaacgtaaagttaccggggactaacggtaccccgtaggtaaggtacgtaccggtaggaaccggtaccgtaaccgggtaccgttaggttaacgttacgtttacggttcggtttaggtaggtaagggtagggaacgggtaccgggttaagttaacggggttaacggtttagggggtttacggggtacgggggttaacccggg

SEQ ID NO: 268363 - DNA, 623 bp, Homo sapiens
  misc_feature: GYAE6OF02FE0B2.28.57.F02.1.454.CMB.1.raw
  modified_base (396)..(396): a, c, t, g, unknown or other
  misc_feature (396)..(396): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcttgggtttttccttgttgcttatttttaaaggtgtccagtgtgaggtgcagctggtggagtcgtgggggagtcttggtccagcccgttggggggtccctggagactctcctgtgcacgcctcgtggtacttcaccttcagttatttatgctatgctacgtggtcccgccaggcctaccgaggggaaggacgtaggaatatgtctcgaggttaattaagaagttaatgacgaaataacattaataattagngaactaaaacgttcttaggtaggtaagggctaagtattacaacctatcctaccgaacggactaacttaccaaagaaccacgtctagtacttacttacaaagtcggactagcgtagacgagtcgtagacgacgacggtcttaggttatagttacggttggtagggtaggaaggtaggtacggtaaggttacggtaacggttgggttagggtacggggacgtaacgggg

SEQ ID NO: 268364 - DNA, 551 bp, Homo sapiens
  misc_feature: GYAE6OF02GW5W8.28.57.F02.1.454.CMB.1.raw
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagccgttgggggggtcccctggagacctctcctgtgcagcctctggattcaccttcagttatttatgctatgcacgtgggtcccgccgaggctccgaaggggaacgggactgggaatatgtctcgaggtattagaagtatgacgaataacatatatatnacaaactctgtgaagggcagtacttcaccntcaccgaggactaacttaccaaagaaccacgntgtatctanaaagtggcagcctgagngctagagacacggntagtatatacgtggtagggagaggagacggtaaggttcggaacgttgggtggtacggggcgtaacggg

SEQ ID NO: 268365 - DNA, 733 bp, Homo sapiens
  misc_feature: GYAE6OF02HJ5NC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtggggggaggcttggtccagccgtggggggtccctgagactctcctgtgcagcctcgtggattccaccttcagttatttatgctatgctacgtcgggtcccgccgacggcctaccggaaggggaacgggtacgtagggaaattagttcgtcgtacgtaggttaattaaggaagttaatggacgtaaataacattataattatagtaactaaactcgtaggtaggaagggtacaggtacttaccaacctacttccgtaccgaagggtaacctaaacgttacccgaaacgaaccaccggtacttacggttaacttccttaacgtaaaggtccgggactacggtacccgtaggaacggtacggtcgtaacgggaacgggtaaccgaccgggttacgtaacgtttattaacggttttaccggtaggggtaggggaaacggtaacggggtaacgggtaccgggttaaggtttaaccgggggtaagggttttaacggggggttcggggttaccgggggtaccggtaaccgggggg

SEQ ID NO: 268366 - DNA, 609 bp, Homo sapiens
  misc_feature: GYAE6OF02FY6DY.28.57.F02.1.454.CMB.1.raw
  modified_base (327)..(327): a, c, t, g, unknown or other
  misc_feature (327)..(327): n is a, c, g, or t
  modified_base (507)..(507): a, c, t, g, unknown or other
  misc_feature (507)..(507): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtcccgcaggctccgaggggaaggactggaatntgtctcgaggttattagaaagtaagtgacgaataacattatattatgacaaactcgtagtagaagggcagtacttacacctatcctaccgagggtaactaacttaccaaagaacctacgctagtacttccttacaaagtcgggctaacgcctaggacgtgacgtggaacggacgtaacgnttagtattaacgtttcggtagggtagggaaggtaagggacggtacgggttaagtttacgggaaaccggtttggggttacgggtacgggggacctaacggggg

SEQ ID NO: 268367 - DNA, 550 bp, Homo sapiens
  misc_feature: GYAE6OF02IJ4AG.28.57.F02.1.454.CMB.1.raw
  modified_base (298)..(298): a, c, t, g, unknown or other
  misc_feature (298)..(298): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctggagactctcctgtgcagcctctggattcaccttcagtatttatgctatgcactgggtccnccgaggctccgaggggagggactggaatatgtctcgaggtattagaagtatgacgaataacatatattatgacaaactctgtgaagggtcagattcacatctacgaggacaattccaagaacacgctagtatcttacaaagtgggacacgcctaggagagctggaggacgacggcttaggtattagttacgttggtgggaggagggagagggtacttagggaaccttagggggttagtcgggggacaagggg

SEQ ID NO: 268368 - DNA, 738 bp, Homo sapiens
  misc_feature: GYAE6OF02FZG13.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattccacctttcgagttatttatgcttagtgctacgtcgggcccgccgacggccgtccggaaggggaacggggtacgtagggaaatagtcggtccgttacgtaagggttaatttaagaaaaggttaagtaggaacgtaaataaactaagttaattaattagtacgaactaaacttcgtaggtaggaacgggactacgtattaccctaacctactccttacccgaagggtaacctaaacgttacccaaagaaccgtacgtacttacgttacttaccgttaacgaaacggttcgggaacacggtaccgtacggaagtacggtacgttacgggaacggaaccgtacgggtaccgttaggtacgtttagttacggttacggggtagggaacgggtaaggggtacgggtaacgggtaacggtttacggggttaaaccgggttggggtttacgggttaccgggggtcgggtaaccggggg

SEQ ID NO: 268369 - DNA, 687 bp, Homo sapiens
  misc_feature: GYAE6OF02JARZ6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttccttgttgctattttaaaggtgtccagtgtgaggtgcagctggtggagtcgtgggggaggtcgttggtccagccgtggggggtccctgagactctcctgtgcagcctctggacttcaccttcagttattatgctatgctacgtcgggtccgccaggcctccgaagggaaggactggaatatgtctctaggtatagaagtaatgacgaaataacattattaattatagaactaactactggttaaggaagggtacaaggtattacccgaactactaccgtacgaacgggtaactaaacgttaaccaaacggaacctaacgtaccgttagttaaacttcccttaaagtaaacgttacggggaccaaccggtaccgttagaaaggacgtacccgttaaagggaacggtaaccgtaccgggactttaggtaactttaacgtaccgggttgggtaacggggaagtacggggtaccggtaaggttaacgggttcggtaaaccggtttggggggttaacgggttcgggaacccgggtacgggg

SEQ ID NO: 268370 - DNA, 778 bp, Homo sapiens
  misc_feature: GYAE6OF02H4HFI.28.57.F02.1.454.CMB.1.raw
  modified_base (167)..(167): a, c, t, g, unknown or other
  misc_feature (167)..(167): n is a, c, g, or t
  modified_base (305)..(305): a, c, t, g, unknown or other
  misc_feature (305)..(305): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttggctgagctggtttcctgtgctatttaagngtccagtgtgaggtgcagctggtggagtcgtgggggagcttggtccagccgtgggggtccctgagactcgtcctgtgcagcctcgtggtattccacctttcgagttatttagcgtacttagtcgctacgtcgggtccnccgtaggtcctaccggaagggacggtacctaggaatcgtgtcctacgtaggtattaggaacgtaagtcgaacgtaaataacgtagtaactttagttaacgtacgaactaaacgtcgtaggttacggaaaggtcgtaaggtacttacccgaaccgttacgttacccgtaccggtaaacgggtaaacttaaccgttaaccgaaacgttaaccgtaaccggttcgttacgttaaccgtttccgtttaaaccggaaaagttccgggtaaacttaccggtacccggttaaggacggttaacgtaccggttacggacgggtaaaccgtaccgggttactaacgggtttacgttaaaccggtttcgggtaagggttacgggtaaacggtacgggttaaccggtaccgggtttaaacggttacgggttaaacccgggttagggggtttaccggtaccgggggtaacccgtaaaccgggggg

SEQ ID NO: 268371 - DNA, 620 bp, Homo sapiens
  misc_feature: GYAE6OF02HDZXO.28.57.F02.1.454.CMB.1.raw
  modified_base (482)..(482): a, c, t, g, unknown or other
  misc_feature (482)..(482): n is a, c, g, or t
  modified_base (507)..(507): a, c, t, g, unknown or other
  misc_feature (507)..(507): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtgtaggctatttaagtgtcagtgtgaggtgcagctggtgagtctgggggaggcttggtccagcctggggggtccctggagactctcctgtgcagcctctggattcaccttcagtatttatgctagtgcacgtcgggtcccgacccagggtcctccggaaggggacgggactagggtaaatagtgtctacgtaggttaattaaggaagttaagtcgacgtaaataacattaatattatacgacaaacttctagtaggacgggcagtacttaccgactatcctacgacggtactaagttccaaagtaacgacgtctagtacttccgttanaaacggtgggaccagtcctaggaancgtctacgggaagaccgtaacggtcttaaggtacttaagtttacggagggtgggaggtaacggaggacgttaaggtacggaaggttcggggttggtacggggccgtaacgggg

SEQ ID NO: 268372 - DNA, 583 bp, Homo sapiens
  misc_feature: GYAE6OF02GDTC9.28.57.F02.1.454.CMB.1.raw
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctggagactctcctgtgcagcctctggattcaccttcagttatttatgctatgcacgtgggtcccgcaggctccgaggggagggacgtaggaatatgtctcgaggtattagaagtaatgacgaataacatattattatagacaaactctgtagagggcagtacttcaccatctacgaggtacaactcaagacngctagtatcttanaagtcggacacgtcgagagagtcgtaggaacggacgacgtctagtattacgttacgtgggttagggaacggtagggacggtacgggttaaggttcgggtaaaggtttgggggttacgggtacgggggtacggtaaccgggg

SEQ ID NO: 268373 - DNA, 713 bp, Homo sapiens
  misc_feature: GYAE6OF02I3YED.28.57.F02.1.454.CMB.1.raw
  modified_base (342)..(342): a, c, t, g, unknown or other
  misc_feature (342)..(342): n is a, c, g, or t
  modified_base (547)..(547): a, c, t, g, unknown or other
  misc_feature (547)..(547): n is a, c, g, or t
  modified_base (640)..(640): a, c, t, g, unknown or other
  misc_feature (640)..(640): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcttcgggtccaggccgtcggggggtccctggacgactctccgtggtcgcgacgtccttctggtattccgtaccctttctaagttacttttatgtacctagtgactacggttcgggttcccgaccgnggtccgtaccggaagggggacgggtaaccgtaggaacttagtcgtactacgtaaggttaattagtaagtaatcgacgtaaataactattaattaattatagaactaacgttctaggtagaggactagtacttacaactactccgacgtaacggtaacaacgttaaccgaaacgaaccgtacgtacttacgttaacttacgttaanaacggttcgggacgcgttccgaggacgtacgacgtaggacggacgtacggtacgttagttaccgttagttacggtgggtaacgggtaaagggngggtaaacggtaagggttacgttaggggtaaacggtttaggggtaccgggttacggggaacccgggtacgggg

SEQ ID NO: 268374 - DNA, 578 bp, Homo sapiens
  misc_feature: GYAE6OF02F3D28.28.57.F02.1.454.CMB.1.raw
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (396)..(396): a, c, t, g, unknown or other
  misc_feature (396)..(396): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggttcagccgtgggggtccctgagactctcctgtcgcacgcctcgtggtacttccaccctttcgagttatttatgctatgctacgtggtcccgcaggcctccgagggaaggctaggaatntgtctcgaggttatagaatangagaataactatatattangacaactngtagaggnagtntcactatcacgaggactaattaccaagaccacgtctagttacttcttaagaagtggcagccgtagacgatcgtaggacgacgtacggcttagtattacgtacgtgggacgggaagtacgggacggtaacgggtagttaacgggtaaggttgggttacgggggtacgggaccgggtaacgggg

SEQ ID NO: 268375 - DNA, 594 bp, Homo sapiens
  misc_feature: GYAE6OF02I1MKJ.28.57.F02.1.454.CMB.1.raw
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (404)..(404): a, c, t, g, unknown or other
  misc_feature (404)..(404): n is a, c, g, or t
  modified_base (450)..(450): a, c, t, g, unknown or other
  misc_feature (450)..(450): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttcggtccagcccgtgggggggttcccctgagactctcctgtgcagcctgtggattcaccttcagttatttatgctatgcacgtgggtccgccaggcctcgagggaggactggatatgtctnaggtattagaagtangngaataacatatattatcgacaaacttctggtggaagggcagtatccacntcgtacgaggactaacgtaccaagaacacgtactatacttacctanaaacgtgggacacggtcccttagagtacggcgtaggaacgtaaccgacggtacttagtattacgttacgtggggttacggaggaggacggtacggtaaggttagggtaacgttagggggttcggtaccggggacggtaacgggg

SEQ ID NO: 268376 - DNA, 556 bp, Homo sapiens
  misc_feature: GYAE6OF02F21GK.28.57.F02.1.454.CMB.1.raw
  modified_base (272)..(272): a, c, t, g, unknown or other
  misc_feature (272)..(272): n is a, c, g, or t
  modified_base (465)..(465): a, c, t, g, unknown or other
  misc_feature (465)..(465): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttttaaaggtgtccagtgtgaggtgcagctggtggagtctgggggaggcttggtccagcctggggggtccctgagactctcctgtgcagcctctggattcaccttnagtatttatgctatgcactgggtccgccaggctccgaggggaagggactgggaatatgtctcgaggttaattagaaagtaatgacgaataacatattatatgacaaactcgtagtagaagggcagtatcaccatctacagggacaattaccaagaacacgctacgtatacttacaaatgggcagcctgagagngtagaggacacggctagtattagtacgtggtggaggaaggagacggtaagttacgggaacgttaggggttacggtcggggacgtaacgggg

SEQ ID NO: 268377 - DNA, 643 bp, Homo sapiens
  misc_feature: GYAE6OF02IY11D.28.57.F02.1.454.CMB.1.raw
  modified_base (174)..(174): a, c, t, g, unknown or other
  misc_feature (174)..(174): n is a, c, g, or t
  modified_base (284)..(284): a, c, t, g, unknown or other
  misc_feature (284)..(284): n is a, c, g, or t
  modified_base (393)..(393): a, c, t, g, unknown or other
  misc_feature (393)..(393): n is a, c, g, or t
  modified_base (472)..(472): a, c, t, g, unknown or other
  misc_feature (472)..(472): n is a, c, g, or t
  modified_base (557)..(557): a, c, t, g, unknown or other
  misc_feature (557)..(557): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggngtccagtgtgaggtgcagctggtggagtcgtgggggaggcttgggtccagccgtggggggtccctgagactctcctgtgcagcctctggattcaccttcagttatttacngtctatgcacgtgggtccgccagggctccgaggggaacgggactagggaactagtgtctcgaaggttattaaggaaagtaatggacgaaattaaacgataataagttanagtactaaaacttctggtaggaagggctaggacttacaacctatccgtccgaagggactaaacttaccgaaacgaaccncgtaacttcggttaaacttctttaacgaaaacgttggggacctaacggtacctagagacgtcgtagaaacgggtaccacggggtntagttacttagttaactggggaggagtaagggacgtacgggtagttacggggaattagggggttcggtagggggaccgtaacgggg

SEQ ID NO: 268378 - DNA, 580 bp, Homo sapiens
  misc_feature: GYAE6OF02FUYY2.28.57.F02.1.454.CMB.1.raw
  modified_base (387)..(387): a, c, t, g, unknown or other
  misc_feature (387)..(387): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgcttatgcactgggtccgccaggctccgagggaagggactaggaatatgtctcaggtattagaagtaatgacgaataacatatattatgacaactctgtagaagggntagattcaccatctcgagggaacaattaccaaagaacacgctcgtatcttacaaagtgggacagccgtagacgaggctaggacggaccgagggtctaggttacttaagttaccgttagggtacgggaaggtagggaggtacgggtaatttggggaaacgttagggggtttgggttacggggaccgtaaggggg

SEQ ID NO: 268379 - DNA, 743 bp, Homo sapiens
  misc_feature: GYAE6OF02FI2EX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgcttatttttaaaggtgtccagtgtgaggtgcagctggtggagtcgtggggggaggtcgttgggtccagcccggtgggggggtccctggacgactcctcctgtcgcacgcctcgtggacttccaccttcagttatttatgtctatgcacgtcgggtcccgccaggcctccgaaggggtaacggacgtaggaatagttcgtcttacgaggttaacgttaaggaaagttaagtggacgtaaataacaattaataatttaagtagaacctaaacttcgttggtagggaacgggactaaggtacttaccgaaccctagttacccgtaaccggaaacgggtaaccttaaacgttaacccgaaaacgaacccgtaaccggtacctttaaggttaaccttacgttaacgtaaaggttaccgggactaaccggtcctaaggtacggacgtcgtaaggaccggtaacgtacggttccttaagttacttaacgttacggttagggtaggggtaacggtaaggggtacggtaacggtaaggtttccggggaaaagggtttggggtttacggggacgggaacccggtacggggg

SEQ ID NO: 268380 - DNA, 744 bp, Homo sapiens
  misc_feature: GYAE6OF02FLM5E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagtcgttggtccagccgtggggggtccctgagactctcctgtgcagcctctggtattcaccttcagttatttatgctatgctacgtgggtccgccgaggcctccggaagggaagggctagggaattagtgtctcgaaggttattaagaaagttaagtggacgtaaataaacattaattaatttagtacgtaactaaaacctttcgtacggtaggaaaggggtctaaagtaactttacccaacccgtattcccgtacccgtaacgggtaacctaaacttaacccgaaaacgaaaccgtaaccggtaccttacggttaaacttacccgtttaagtaaaacgttcggggaaccgtaaccggaccgttacggaagggtacggtacgtaagggaaccggaaccggtaaccgggtacttacggttaattacgttaacggttaggggtacggggtaaggaaccgggtaaggaccggggttaagttacggggtaaaccggttagggggtttacggggttaccggggaccggtaaccggggg

SEQ ID NO: 268381 - DNA, 707 bp, Homo sapiens
  misc_feature: GYAE6OF02FONWE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtcccctgagactctcctgtgcagcctctggattcaccttcagttatttatgctatgcacgtgggtcccgccgaggcctccgaggggaacgggacgtgggaatagtgtactcgaggttattagaagtaatgacgaaataacgattaattattataggacaaacttcgtggtaggaacggcaagtactttaccgaacctattccgtaccgaacgggtaactaaacgttaccgaaacgaaaccacggtactacgttaacgttaccttaacgtaaaagtcgggtaacctacgtacccgttaggaacgtaggtccgttaaagggagggtaaaccccaacggtaccgttagttaaccgttaagttaccggtttgggtaacggggtaaggtaacgggtaagggtaaccgggttaaacggtttcggggttaaaagggtttacgggggtttacggggttacgggggacccgtaaacgggggg

SEQ ID NO: 268382 - DNA, 535 bp, Homo sapiens
  misc_feature: GYAE6OF02FTVG4.28.57.F02.1.454.CMB.1.raw
  modified_base (297)..(297): a, c, t, g, unknown or other
  misc_feature (297)..(297): n is a, c, g, or t
  modified_base (395)..(395): a, c, t, g, unknown or other
  misc_feature (395)..(395): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccnccaggctccgagggaagggactggaatatgtctcaggtattagaagtaatgacgaataacatatattatgacaaactctgtagaagggcagattcacntctccaggacaattccaagaacacgctagtactcttacaaatgggacagcctgagagcgtgacggacacggctgtattagttactggngggagaggagacgggtaagttgggaacgtaggggttggtcggggacacgggg

SEQ ID NO: 268383 - DNA, 737 bp, Homo sapiens
  misc_feature: GYAE6OF02GP5HL.28.57.F02.1.454.CMB.1.raw
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (432)..(432): a, c, t, g, unknown or other
  misc_feature (432)..(432): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtgggggtccctgagactctcctgtagcagcctcgtggatttccacctttcagttatttatgtctatgctacgtgggtcccncaggcctccggaaggggaaggactaggtaatagtcgtcgtcgtaggttaagttaagaagttaaatggtaacgtaaattaacaagttaattaagtttangaactaaacttcgtagtaggaacggntaagtactttacaaccgtataccctacgacgggtaaacctaagttaacccaaaggaaaccctcgtacgtttacgttaattccgttaaaccgtaaagttccgggactaaccggtacccgtaggaacgtagtacggttaacgggaccgtaaccggaacggttacgttaggttaaactttacggtttaaaccggttggggtaacgggtaagggtaacgggtaaacgggtaccgggttaaaggttttacgggggtaaaccgggttttaggggggttacggggtaccggggtaacccggggtaaccgggg

SEQ ID NO: 268384 - DNA, 674 bp, Homo sapiens
  misc_feature: GYAE6OF02ITME5.28.57.F02.1.454.CMB.1.raw
tcagagtacgctatcacgaccggtgctcgatttagctcgatatagttggggtcgtgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggagcttggtccagccgtggggggtccctgagactcctcctgtgcagcctcgtggattcaccttcagttatttactgctatgctacgtcgggtccgccgagggtcctaccggagggggaacgggacctagggtaatacgtggttcctacgtaggttattaggtaaagtaagttgacgaaataaacgagttaattaattattacgactaaacgtctaggtaggaacgggcaaggtacttaccgacacttccgtaccgaacgggtaactaacgttccaaagaaccctaggaccttaggtaacttccgttaacaaacgtgggacctacggtacccttaggaacgtagtcccgttaaggcggtaaaccgacgggtcctagttagttacgtacgtaggtacggggagtaagggtacggtacggtaagtttacgggaacggttaggggttaggtacggggactaacgggg

SEQ ID NO: 268385 - DNA, 733 bp, Homo sapiens
  misc_feature: GYAE6OF02HME49.28.57.F02.1.454.CMB.1.raw
  modified_base (146)..(146): a, c, t, g, unknown or other
  misc_feature (146)..(146): n is a, c, g, or t
tcagagtacgctatcacgaccggtgctcgatttagctcgatatagttgggtctgggagaggagcccccgccctgggtttacccaggtgttctcatttggtgatcagcactgcacacgagaagagtcatgacggagtttgggctganctgggttttcctgttgctatttttaaaggtgtccagtgtgaggtgcagtcctggtggacgtcgtgggggacggcgttggtcccaggccgtcggggggtcccctgagactctccctggtgcacgccttcgtggtacttcctaccctttcgaagttacttttagtcgtacctaagttcggacctacggtccgggtacccggacccgagggtccctcccgggaaaggggtaacggggaccgttaagggaaattaacgttgtaccctgtaggtaattaaggaaagttagtacgacgtaaattaacattagttaacttatcgaactaaactcgttggtagaaggtcagtactactacacgttccaccgaaggacctaaattcccgaaaagaaccaccggtacttcgtaaacttccttaaagaaacggtcgggtactaccggaccttaggacgtaacggtcgttacggaacggttaccggaacgtttcgtaagttacttaacgtttacgggttaagtaggggaacggtaagtggaaccggttaagttaccgggtaaagggttacgggttggggttcggggaccggtaacgggg

SEQ ID NO: 268386 - DNA, 677 bp, Homo sapiens
  misc_feature: GYAE6OF02H0VOY.28.57.F02.1.454.CMB.1.raw
  modified_base (294)..(294): a, c, t, g, unknown or other
  misc_feature (294)..(294): n is a, c, g, or t
  modified_base (299)..(299): a, c, t, g, unknown or other
  misc_feature (299)..(299): n is a, c, g, or t
  modified_base (578)..(578): a, c, t, g, unknown or other
  misc_feature (578)..(578): n is a, c, g, or t
  modified_base (590)..(590): a, c, t, g, unknown or other
  misc_feature (590)..(590): n is a, c, g, or t
  modified_base (608)..(608): a, c, t, g, unknown or other
  misc_feature (608)..(608): n is a, c, g, or t
tcagagtacgctatcacgaccggtgctcgatttagctcgatatagttgggtctgggagaggacgcccccgccctgggtttcccaggtgttctcatttggtgatcacgcactgcacacagaagagtcatgacggagtttgggctgagtcgttgggttttccttgttgcttaatttttaaaggtgtaccagtgtgaggtgcaggcgtggtggagtcgtgggggagtcgttggtccagccgtggggggtccctggagactctcctgtgcagcctcgtggtattccacctttcagttntttangtctatcgtctacggtcgggtcccgccgtaggcccgtaccggaagggggtaacggggactagggtaattagtcgttacgtacgtaaggttaattaaggaaaagttaacgtgtaacgtaaataaacgtaattatttaaagttagtacgtaaactaaacttcgttaagggtaggaaacgggtactagttaactaccctaactacttaccgtaacgacgggtaaactaacgtaaccgaaagactaactcgtatactataacgagcggactacgctagagtcngtaggacaccgngtatagttatacggttgngggtaagggaggtacgagggtaaccgtaggttgggtaaacgttgggggtgggaccgggttagacggggg

SEQ ID NO: 268387 - DNA, 593 bp, Homo sapiens
  misc_feature: GYAE6OF02HSKHI.28.57.F02.1.454.CMB.1.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttttaaaggtgtccagtgtgaggtgcagctggtggagtctgggggaggcttggtccagcctggggggtccctgagactctcctgtgcagcctctggattcaccttcagtatttatgctatgcactgggtcccgccaggctccgagggaagggctggaatntgtctacaggtattagaagtatgacgaataacatatattangacaactctgtagaagggcagattaccactatcctaccgagggactaagttccaaagaacaccgacttagtacttacttacaaagtcgggacaacggccttagagacgtcgtaggaacggaccgacgggtactagttagttagtttacgtggttaggggaagagggtaggtacgggtaagtttacgggaaacggttaggggtttcgggtcggggaccggtacgggg

SEQ ID NO: 268388 - DNA, 569 bp, Homo sapiens
  misc_feature: GYAE6OF02H90EY.28.57.F02.1.454.CMB.1.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (470)..(470): a, c, t, g, unknown or other
  misc_feature (470)..(470): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcttggtccagccgtggggggtccctgagactctcctgtgcagcctctggattccaccttcagtatttatgctatgcacgtcgggtcnccaggcctccgaaggggaggactggaatatgtcncgagtattagaagtatgacgaataacatatattanagcaaactntgtagaaggcagatcaccatcacgaaggacaacttaccaagaacacgcttagtaactctttacgaaatcgggctacgaccgttgagtcgngtacggacggaacacgggtatagtacgttagtttacgngggtagggaagaggtacgacggtaaggttcggaaggttaggggtgttcggggactacgggg

SEQ ID NO: 268389 - DNA, 608 bp, Homo sapiens
  misc_feature: GYAE6OF02FIWNB.28.57.F02.1.454.CMB.1.raw
  modified_base (438)..(438): a, c, t, g, unknown or other
  misc_feature (438)..(438): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccgaggggaaggactgggaatatgtctcgaggttattagaagtaatgacgaataacattaatattatgacaaacttctagtaggaagggcaagattacaacctattcaccgagggactaacgttacccaaanaaccgtacgctagttaacttccttaacgaaagtcgggactacggacctaggacgacgtcgtaggacgaccgacggtctagttatacgtttacgtgggtagggaaggtagggacggacggttaaggttacgggtaacggttaggggttggtacgggggtacctaacggggg

SEQ ID NO: 268390 - DNA, 659 bp, Homo sapiens
  misc_feature: GYAE6OF02FM626.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcgttggtccagccgtggggggtccctgagactctcctgtgcagcctctggacttcaccttcagttatttatgcttagtcgctacgtcgggtcccgacgacggtctcccgaaggggaacggacgtagggaatagtcgtctcgtaggtatagaagtatgacgaataacataatattatgactaaactcgtagtagaacgggcaagtactccacctatccgtacgaaggaacctaacgttaccgaaagaacctacgtcgtattaacgtactttaacgaattcgggacaacgtaccgtaggaacgacggtacgtacggaacggacgtacgggtcttaaggttacttaacgtttaccggtaggtacgggggaaggtaacgggtacgggtaaccggttaaggttacggtaaacgggtttggggtacgggttacggggaacggtaccgggg

SEQ ID NO: 268391 - DNA, 572 bp, Homo sapiens
  misc_feature: GYAE6OF02G2IML.28.57.F02.1.454.CMB.1.raw
  modified_base (396)..(396): a, c, t, g, unknown or other
  misc_feature (396)..(396): n is a, c, g, or t
  modified_base (484)..(484): a, c, t, g, unknown or other
  misc_feature (484)..(484): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtgcagcctctggattcaccttcagttatttatgctatgcactgggtccgcaggctccgagggaggctggaatatgtctcgagttattagaagtatgacaataacatatattatgactaactctgtagaagggcagtactcaccntccgacgaggactaacgtaccaaagaccacgcttgtactcgttaacaagtcggacacgtccaggagagtcgtaggacggacacgggtntaggttaagttcgttaacggtgggtagggaggtaaggagggtacgtaagttgggaaacggtttggggtggtacggggacgtacggggg

SEQ ID NO: 268392 - DNA, 688 bp, Homo sapiens
  misc_feature: GYAE6OF02GNW7P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagccgtggggggtccctggagactctcctgtgcagcctctggattcaccttcagttatttatgctatgctacgtgggtccgccgaggcctccgaggggaacggactggaatatgtctgaggtatagaagtatgacgaataacatatattatgacaaactcgtagtaggaaggcagtacttaccacctattaccgtaccgaaggggaacctaaacgttacccgaaaaggaaccacggtcttaggtaactttaccgttaacgaaacggtacgggacctaacggaccgttaggaacggtacggtacggtacggtaacgggaccctaacgggtccgttaggtttaacttaacggtttacgttaaggggttacgggggaacggtaaggggtacgggtaaccgggttaacggtttacgggggtaaaccggtttagggggtttacggggtacgggggtacccgtaacgggggg

SEQ ID NO: 268393 - DNA, 695 bp, Homo sapiens
  misc_feature: GYAE6OF02H7IT3.28.57.F02.1.454.CMB.1.raw
  modified_base (259)..(259): a, c, t, g, unknown or other
  misc_feature (259)..(259): n is a, c, g, or t
  modified_base (605)..(605): a, c, t, g, unknown or other
  misc_feature (605)..(605): n is a, c, g, or t
  modified_base (617)..(617): a, c, t, g, unknown or other
  misc_feature (617)..(617): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtgagtcgtgggggagcgttggtcccaggccgtggggggtccctggacgtactctcctggtgccngcctcgtggacttccgtaccttcagttatttagtcgtctatggcctacgtcggggtcccgccgaggtcccttaccggaaggggtaacggactgggaaacttgtgtcgtacgtaaggttaattaggaaagttaagtacgaacggtaaataactaagttattaattactacgacctaaaacttcgtaggtaggaaggtcaagtacttaccgactactccgtacgaagggaactaagttaccgagtaaccgacgtcgtagttacttacgttaactaaaggtcggtacaccgtaccgtagacgacgtacgagtacggaaccgaacgttacctagttaagttaccgttagngggttaacgggngtaaagggtaccggttaaggtaacggttaagggtaccgggtttaaggggttacgggtacggggtacccgtaacggggg

SEQ ID NO: 268394 - DNA, 572 bp, Homo sapiens
  misc_feature: GYAE6OF02IKMAR.28.57.F02.1.454.CMB.1.raw
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcttggtccagcctggggggtccctgagactctcctgtgcagcctctggattcaccttcagttatttangctatgctacgtgggtccnccaggcctccgaggggaacggctggaatatgtctcgtaggtatagaataagtgacgtaaataacatatattanagactaaactctagtagaagggcaagtattcactatcctacgaggaactaactacaagaacacgctagtactcttacaaagtcggacacgtcagagacgcgtacggcggaacaccggtcttagtataagttacggtggtagggaagaggacgacggtagttagggaaccgttaggggttggacggggactacgggg

SEQ ID NO: 268395 - DNA, 801 bp, Homo sapiens
  misc_feature: GYAE6OF02II4NZ.28.57.F02.1.454.CMB.1.raw
  modified_base (291)..(291): a, c, t, g, unknown or other
  misc_feature (291)..(291): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttggtccaggccgtggggggtccctggagactctcctgtgcagcctctggacttccacctttcagttattttangtactatcgctacggtcgggtcccgccgacggtcctaccggaagggggaacgggtacgtagggtaatagttcggtcttacgtacgggttaatttaaggaaacgttaatggaacgtaaataaacgtaattaatttaatttagtaggaacctaaacttaccgttaggtaggtaaacgggcgtaacgtactttaccgaaccttacttcccgtaacccggaaagggtaacctaaaacgttacccgaaacggtaaaccctaccggtactttacggtaactttaccgttaacgtaaacgggtcgggtaactaacggtacccgttaaggaacggtacgtccgttaaacggggaccggtaaacggtccgggtacgttaggttaacgtttaacggtttacggttaggggtaacggggtaaaggtaacggggttaacggaaccgggggtttagtttaacgggggtaacggggttttacgggggtttacggggtccggggggtaacccgggtaacgggggg

SEQ ID NO: 268396 - DNA, 672 bp, Homo sapiens
  misc_feature: GYAE6OF02GAI78.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttggtccagccgtggggggtccctggagactctcctgtgcagcctctggattccaccttcagtatttatgctatgcacgtgggtccgccaggcctaccgaggggaaggacgtggaatatgtctcgaggttattagaaagtaatgacgaaataactattaataattatagtactaaactctagtaggaagggcagtacttaccaccgatcccgtacgaagggaacctaacttaccgaaagaaccgacgtcgttacgtacttacccttaacgaaaggttccgggacctaacggcccttagggaagtacgtacgttacgggaacggtaccgtaacgggtcgttaacgttaattaaccgttacggttggggtagggtaaggacggggtaacggcggttaaaaggtttcgggtaaaccggggttgggggtttacggggttacgggggccgtaaacggggg

SEQ ID NO: 268397 - DNA, 656 bp, Homo sapiens
  misc_feature: GYAE6OF02G1OMA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtcccctgagctctcctgtgcagcctctggattcacccttcagttattttatgtctatgcactgggtcccgccaggcctaccgaggggaacggggactaggaatagtgtctcgtaggtattaagaagtatgacgaataacatatatatagacaactctgagagggctagatcacatccacgtaggactaacttaccgaagaaccacggtactaggttaactacctttacgtaaacgtcgggtccagtacccgttaggacggtacgtccgtaaggaacgggtaacgtaccgggttatacggtttaacttaagtttaccggtaggggtacggggtaaagggtagggacgggtaacgggttaacggtttcggggttaaaacggttcgggggggttttacgggtacgggggtacccgtaaccggggggg

SEQ ID NO: 268398 - DNA, 618 bp, Homo sapiens
  misc_feature: GYAE6OF02FXGZH.28.57.F02.1.454.CMB.1.raw
  modified_base (305)..(305): a, c, t, g, unknown or other
  misc_feature (305)..(305): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctggagactctcctgtgcacgcctcgtggattccaccttcagttatttatgctatgcacgtgggtccnccaggctccgaggggaaggactggaatagtgtctacgaggttattaagaagtaatgacaaataacatatattatgactaaactctagtagaaggcagtattaccactatcctaccgaaggtactaacgtaccaaagaaccagtctagttaacttccgttaacaaagtcgggacaacggccttggaacgtcgtcgtaggaacggtaccgaccggtattggttaattacgttacggtgggtagggaacgtaggggtacgtacgggtaagttcgggaaacggtttagggggttcggaccggggtaccgtaacgggg

SEQ ID NO: 268399 - DNA, 654 bp, Homo sapiens
  misc_feature: GYAE6OF02JCGKB.28.57.F02.1.454.CMB.1.raw
  modified_base (289)..(289): a, c, t, g, unknown or other
  misc_feature (289)..(289): n is a, c, g, or t
  modified_base (428)..(428): a, c, t, g, unknown or other
  misc_feature (428)..(428): n is a, c, g, or t
tcagagtacgctatcacgaccggtgctcgatttagctcgatatagttggggtctgggagaggagcccccgtccctgggtttcccaggtgttctcatttggtgatcagcactgcacacagaagaggtcatgacggagtttgggctgagctgggttttccttgttgcttatttttaaaggtgtccagtgtgaggtgcagctggtggagtcgtgggggaggtcttggtccagccgtggggggtccctgagactctcctgtgcagcctctggattcaccgttcagttatttangctatgctacgtgggtccgccgacggcctaccgagggaagggactaggaatatcgtctcgaggttattaagaagtatgacgaataacataactattagtagactaaactctagtaggaaggtcagtacttaccaacgtntaccgtccgaagggtactaaacgtcaaacgtaccacgtcttagtaacttccgttacaaaggtcgggccaaggtacccgtaggacgtacggtcgtaggtaaccggaccgtacggtcttaagttacgttacgttacggtagggtgggaacgggtaaccggtacggacgggttaacttaacggggtaacgtttaacgggggtcgggtaccgggggtcccgtaacggggg

SEQ ID NO: 268400 - DNA, 557 bp, Homo sapiens
  misc_feature: GYAE6OF02F0WBR.28.57.F02.1.454.CMB.1.raw
  modified_base (298)..(298): a, c, t, g, unknown or other
  misc_feature (298)..(298): n is a, c, g, or t
  modified_base (459)..(459): a, c, t, g, unknown or other
  misc_feature (459)..(459): n is a, c, g, or t
  modified_base (477)..(477): a, c, t, g, unknown or other
  misc_feature (477)..(477): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctgggggggtccctgagactctcctgtgcagcctctggattcaccttcagtatttatgctatgcactgggtccncaggctccgagggaaggactggaatatgtctcaggttattagaagtaatgacgaataacatatatatgactaaactctggtagaagggcagtattaccaccattccacgtagggactaattaccaagacacgctgtatcttacaagtcgggacagcctganagtctagagtacacgggntacgttatagttcgtggtcgggaagaggtaggcggtaagttcggaacggtttaggggtcggttacggggccctaaggggg

SEQ ID NO: 268401 - DNA, 835 bp, Homo sapiens
  misc_feature: GYAE6OF02H7HCZ.28.57.F02.1.454.CMB.1.raw
  modified_base (299)..(299): a, c, t, g, unknown or other
  misc_feature (299)..(299): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctattttaagtgtcagtgtgagtgcagctggtgagtcgtgggggaggtcgttggtccagccggtggggggtcccctagagcttcgtcctgtgcagcctcgtgacttcctacttcaagttatttatcgtactagtcgtaccncgttcggtccgacccgtacggtcccgtacggaacgggggaacggtacggtacggtaagttaacgtcggttacctacggttaaggttaagtttaaaaggaacgttaaagtcggaaacgtaaactaaacgtattaaacgtttaagtttaacgacggtaaaccttaacgtttcgtacggttaagggacggtaacctagtaacgtaccaacctaacgttccgtaaccggtaacgggtaacctaaccgttaacccgaaacggtaacccgtaccggttactttaacgtacgttaaccgtttaaccgtaacgtaccgggtaaccgtaacggtacccgtaggtaaccggtcggtaaccggtacgggtaacgggaacccggtaacggttacccggtagttttaaacggttaccggtttaaccgggttaggggttaccgggtaaagggtaaacgggttaacggaaccgggtttaacgggttaaacgggttaacccggggtttaggggtttaacccgggggtcggggtaacccgggtaacccggggg

SEQ ID NO: 268402 - DNA, 591 bp, Homo sapiens
  misc_feature: GYAE6OF02GWYEP.28.57.F02.1.454.CMB.1.raw
  modified_base (462)..(462): a, c, t, g, unknown or other
  misc_feature (462)..(462): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccaggccgtgggggggtccctgagactctcctgtgcagcctctggattcaccttcagttattttatgtctatgcacgtgggtcccgccgaggctccgaggggacgggactaggaatatgtctcgaggtattagaagtatgacgaataactatatattatgacaactctgtaggaaggcagtacttaccacactcctaccgagggtaacaacttaccaagaaccacgtctacgttatcctanaagtgggacacgccgtagagacgtcgtagacggtacgacggtctagttatacttacggtggtagggagagggtaggtaggtaacgttagggtaacggttaggggttcgggtacgggggacgtaacgggg

SEQ ID NO: 268403 - DNA, 564 bp, Homo sapiens
  misc_feature: GYAE6OF02FV5TS.28.57.F02.1.454.CMB.1.raw
  modified_base (300)..(300): a, c, t, g, unknown or other
  misc_feature (300)..(300): n is a, c, g, or t
  modified_base (461)..(461): a, c, t, g, unknown or other
  misc_feature (461)..(461): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtccnccgaggcctccgaggggaacgggactgggaatagtgtctcgaggtattagaagtaatgacgaataacatatattatgacaaatctgagaggcagtattcacatctccgaggactaattaccaagaccagctgtactcttacaagtgggactagccgtgagngcgtaggaacggacgtacgggcttaggtattacgtacgtggtagggaggaggtaggacggtaagttagggaaccgttgggttgggtacggggaccgtaagggg

SEQ ID NO: 268404 - DNA, 703 bp, Homo sapiens
  misc_feature: GYAE6OF02IHYF6.28.57.F02.1.454.CMB.1.raw
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctaggacgactctcctgtgcagcctctgattcaccttnagtatttangctatgacacgtgggtccgccaggcctacgaaggggaagggactaggaatatgtctacgaagttaattaggaaacgtaatggaacgtaaaataaactagttaattaagtttatcgaactaaaacctcttaggtaggaacgggacaagtacgttaccaacctaatcctaccgaagggaactaaacttacccgaaaagaaccaacggtactacggttaatccgtttaactaaaagtcgggacacgaccgttggaaaccgtagtacgtaacgggaacgggtaccgaaaccgggtcttaacgggttaattaacggtttacggtaacgggttaaggggaaggaacgggtaacggaaccgggttaaacgttagggtaaaccggttagggggttttaaggggtaccggggtaacggaacccggggg

SEQ ID NO: 268405 - DNA, 754 bp, Homo sapiens
  misc_feature: GYAE6OF02GLYK8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggtcgttggtccgaggtccgtggggggtcccctggagtactctcctgtgcacgtcctcgtggattccacccttctaagttatttatgtctagtcgctaccgttcgggtcccgccgacggtccgtccggaagggggaacgggacgttagggtaaattagtgttcctagtaagggtttaagttaaggtaaagttaaagtacggacgtaaattaaacgtaattaaatttaatttagtacgtaaacctaaaacgttcgtaggtaggaacgggtacaagtacttacgaacctacttaccgtaccggaacggtaacctaacgttaacccgaaacggaaacctaccggtacttacgttaacttacgttaacgtaaagtcgggacaaccggtcacgtaggacgtacgtagggaacggaccgaacggttacgtacgttaagttaacgtttacggttacgggtaagggaacggtaacgggtaaggacgggtttaaggtaccggggttaacggttaggggggtttcggggacggggtaccgggtaacggggg

SEQ ID NO: 268406 - DNA, 611 bp, Homo sapiens
  misc_feature: GYAE6OF02J0VVN.28.57.F02.1.454.CMB.1.raw
  modified_base (212)..(212): a, c, t, g, unknown or other
  misc_feature (212)..(212): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (526)..(526): a, c, t, g, unknown or other
  misc_feature (526)..(526): n is a, c, g, or t
tcagagtacgctatcacgaccggtgctcgatttagctcgatatagtttggggtcgtgggagaggagccccgccctgggtttcccaggtgttctcatttggtgatcagcactgcacacagaagagtcatgacggagtttgggctgagctggttttccttgttgctattttaaggtgtccagtgtgagtgcagctggtgagtcgtggggaggtnttggtcagccgtggggggtccctgagactctcctgttcgctagtcctcgtcggattcctaccttcaggttactttaactcggtcttacgtgaccgtacggttcggttccgcccgaggtccttacccggagggtaacggtctaggaatctgtcncgtaggttatagaagttangacgaatacnttactntacgtgacctaatctgacggagtctagagttccactagtctcgaggtactatacgaagactcgatagttactacgtacaagtcggatacgggtctaacggtgaacgttcgagtacggaacacggtntacggtactaagtttcggaggtaccggagacgggacgtacggttaccgtttagaccgggtttaggtggtaccgggagtaccgggg

SEQ ID NO: 268407 - DNA, 619 bp, Homo sapiens
  misc_feature: GYAE6OF02IH53E.28.57.F02.1.454.CMB.1.raw
  modified_base (426)..(426): a, c, t, g, unknown or other
  misc_feature (426)..(426): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgactacgtcgggtcccgccgaggtcctccggaaggggaacgggacgtaggaatagtgtctcgtaggttattaaggaagtaagtgacgaataacatataattatgactaaactctgtaggaagggcagtacttcacctntctaccgaggtaacctaagttacccaagaacctacgtctagtattaccttacaaagtcgggacacgtccgtagagagtcgaggaacggacgaccggtattagtattacgtttacggtagggttagggagtagggacgtacgggttaagttacgggtaacggttaggggttacggtcggggaccgtaacggggg

SEQ ID NO: 268408 - DNA, 554 bp, Homo sapiens
  misc_feature: GYAE6OF02FV5Q8.28.57.F02.1.454.CMB.1.raw
  modified_base (385)..(385): a, c, t, g, unknown or other
  misc_feature (385)..(385): n is a, c, g, or t
  modified_base (475)..(475): a, c, t, g, unknown or other
  misc_feature (475)..(475): n is a, c, g, or t
  modified_base (488)..(488): a, c, t, g, unknown or other
  misc_feature (488)..(488): n is a, c, g, or t
tcagagtacgctatcacgaccggtgctcgatttagctcgatatagttgggtctgggaggaggagcccccgccctgggtttcccaggtgttctcatttggtgatcagcactgcacacagaagagtcagtgacggagtttgggctgagctgggttttccttgttgctatttttaaaggtgtccagtgtgaggtgcagctggtggagtcgtgggggaggcgttggtccagccgtggggggtccctggagactcgtccgtgtgcagcctcgtggattccacctttcgagttatttatgctatgcacgtggtcccgccaggcctccgagggaacgggactaggaatagtgtctcgaggtattagaagtatgacgaataacatagtattangacaactcgtagtaggacggcaggattccacctatctccgaggacaacgttccaaagaccagctagtatcttacaagtgggcagctgagngctgagacgcgtntagtatattaggtgtagggagaggtgacggtagttagggaagttagggttggtcgggacgtacggg

SEQ ID NO: 268409 - DNA, 834 bp, Homo sapiens
  misc_feature: GYAE6OF02F76PP.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcacgccctcgtgtactcctaccttctagttatttatcgtacttagtcgcgtacggttaccgggtcccgaccggacggccgtaccggaagggggtaacgggtacgtaggtaaacttgttacgtaccgtacgtaaggttaagttaaggtaaacgttaagtacggaaacgtaaactaaactaagttaactttaagtttacgtacgtaaactaaaaccttcggttaaggtacggtaacggggtacgtaagttaccgttaacccacgtacgttaccccgtaccgggtaaacggtaaccttaaccgtaaccgtaaacggtaaccgtacgttaccgttagttaccttacttaaacgtaaacgggtcggtacccgtaacggtaccggtaggtaacggaccggttacgaccggggtaaacggtaccggtacggtacggtttacgttaagtttaccggtttaacggttcgggggtaaggggtaacggggtaacgggtacggggtaacgggtttaacgggttacgggtttaaaccgggggtttagggggtttaccggggggtacccgggggtaacgggttaacccggggg

SEQ ID NO: 268410 - DNA, 586 bp, Homo sapiens
  misc_feature: GYAE6OF02HG2WH.28.57.F02.1.454.CMB.1.raw
  modified_base (363)..(363): a, c, t, g, unknown or other
  misc_feature (363)..(363): n is a, c, g, or t
  modified_base (469)..(469): a, c, t, g, unknown or other
  misc_feature (469)..(469): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagccgtggggggtccctgagactctcctgtgcagcctctggattcaccttcagttatttatgctatgcacgtcggtccgccgaggcctccgagggaaggctggaatatgtctcgaggttattagaagtatgacgtaataanattaatattatgactaaactctagtaggaaggcagtatcaccattcctcgaaggacctaacttacaaacgtaccacgtctagtattcttacaaatgggacagccgngacgagctaggaggacacggtcgttagtattagttaggttggagggaacggtagggacggtaacgggtaagtttacgggaacggtttaggggtacgggtacggggaccggtacgggg

SEQ ID NO: 268411 - DNA, 983 bp, Homo sapiens
  misc_feature: GYAE6OF02GH0C2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcttggtccagccgtggggggtccctgagactctcctgtgcagcctcgtggacttccaccttcagttatttatgtctatgcacgtcgggtcccgccgtacggccgtacccggaagggggaaacgggtaccgtaggggtaaacttagttcggttaccgttaccggtaagggtttaacgttttaaaaggtaaacggttaaaacgttacggtaaaccgggtaaaaactttaaaccgttaaatttaaaaggtttaaacttttaaagttaaccggtaaaccctaaaaacccgttttccggttaagggttaacggggtaaacggggtaaccgtaaaggttaccgttttaaaccccgaaacccctaaacggttttacccccttaacccgggggaaaaacggggttaaaccctttaaaaacccggtttaaacccccgaaaaacgggtaaaaccccttaaacccgggttacgtttaacggtttaaacctttcccgttttaaaacggaaaaacggttccgggggtaacctaaccggtacccgggttaagaaccgggtaacgttccggggttaaacggaaaccggggaaccccggtaaccgggttaccgtttaagggtttaaacctttaccggttttaaaccggggtagggggttaaccgggggtaaaagggtaacgggggtaaaacgggtacccgggtttaaagggtttaacccggggttaagggggttttaaaccgggggttcgggggtttaaccgggggggaccccggttaaacgggggg

SEQ ID NO: 268412 - DNA, 713 bp, Homo sapiens
  misc_feature: GYAE6OF02HYE6E.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgctatttttaaaggtgtccagtgtgaggtgcagcgtggtggagtcgtgggggaggtcttggtccagccgtggggggtccctgagactctcctgtgcagcctgtggtacttcctaccttctagttattttagtgtcttatcgtctacgttcgggtcccgccgaggtcctccggaaggggaacggctaggatagtcgtctacgtaggtattaagtaagtagtacgacgtaaataacattataattagtacgtactaaaacttcgtaggtaggaagggactaaggtacttaccgaacctacgttccgtaaccggtaacgggtaaacctaacgtaaaccgaaacgaactaaccgttacgttaggtaacctttaccgttaacaaaggttcgggacgtacgtaccgtacggagtacggtacgtaacgggacgtaacgcggtacgttagtttacgttaacgttacggttagggtaacgggtagggtaacgggaacggttacggtaacggtttacggggaacggtttagggggttacgggttacggggaccggtaacggggg

SEQ ID NO: 268413 - DNA, 755 bp, Homo sapiens
  misc_feature: GYAE6OF02IRGFD.28.57.F02.1.454.CMB.1.raw
  modified_base (132)..(132): a, c, t, g, unknown or other
  misc_feature (132)..(132): n is a, c, g, or t
  modified_base (444)..(444): a, c, t, g, unknown or other
  misc_feature (444)..(444): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggngtttgggctgagctgggtttccttgttgctattttaaggtgtcagtgtgaggtgcagctggtggagtcgtgggggagcttgggtccagccgtggggggtccctggagacgtctcctgtcgcagcctctaggattccacctttcagttatttactgcttaatcgctacgttcgggtcccgacacgggtctccggaaggggtacgggactagggtaatagtcggtctacggtaaggtagttaaggaaagtaatggacgtaaataacgtattaattattaagtgtaactaaacgttctaggtaggaaacgggtanaacggtaactttaccaaccgtaacgttcgttaacccggaagggtaacccttaaagttaaccccggaaaaggaacccgtaaaccggtcgtttaaacggtttaccttaccgttaacgtaaaacggtcggggtaacctaggtaccccgtaggaacggaacgtaccgtagggtaacggtaaccgacgggtaccttaacgggttattaacggtttacggtaacgggttagggaacgggtaagggtaaccgggtaacgggttaaggtcggggttaaccgggttagggtaccggggttaccgggacggtaaccggggg

SEQ ID NO: 268414 - DNA, 384 bp, Homo sapiens
  misc_feature: GYAE6OF02I7QU2.28.57.F02.1.454.CMB.1.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (374)..(384): a, c, t, g, unknown or other
  misc_feature (374)..(384): n is a, c, g, or t
tcagagtacgctatcacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccgccaacatagccttctccgtcccccttgcagtaacaccaagtacaggaatattaacctgtttcccatcgactacgccttcggcctcgccttaggggcactcaccctcgcccattaacgttgacaggacccttggctcggnagcggntgcgaggcncatagnnnnnnnnnnn

SEQ ID NO: 268415 - DNA, 691 bp, Homo sapiens
  misc_feature: GYAE6OF02GNCED.28.57.F02.1.454.CMB.1.raw
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagttgggctgagctgggttttccttgttgctattttaaaggtgtcagtgtgaggtgcagctggtggagtctgggggaggcttggtccagccgtggggggtccctggagactctcctgtgcagcctctggattcaccttcagttattatgctatgcactgggccncgaggctccgagggaacggactggaatagtcgtctgaggtactaggaagtatcgagtaataacgattaatagttanagactaaacgttctaggtaggaaacgggctaaggtacttaccacctagtacctacccggagggtaaactaacttaacccgaaagtaaccgtacgtaccgttagttacttaccttaacgaaagtcgggactacgtacctaggtaacggaacgtcgtaggaacggacccgtaacgggtaccgttaggttaacttaacgtttaccggtaagggttacgggggaaacgggtacgggtaagggtaaccgggtaagggttttaacccgggtaaaggggtttacgggggtttaacgggggtacggggggtacccgttaacggggggg

SEQ ID NO: 268416 - DNA, 616 bp, Homo sapiens
  misc_feature: GYAE6OF02GDCHA.28.57.F02.1.454.CMB.1.raw
  modified_base (445)..(445): a, c, t, g, unknown or other
  misc_feature (445)..(445): n is a, c, g, or t
  modified_base (500)..(500): a, c, t, g, unknown or other
  misc_feature (500)..(500): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatgctacgtgggtcccgcaggcctccggaggggaaggactggaatagtgtctcgaggtataagaagtaatgacgaatactatatattatgactaaactctagtaggaaggcagtactccactatcctacggaaggtaactaacgtaccaagacacgtntacgtatcgttacaagtcggctagccgtgagcgtcgtagaacggtacgaccggtnttaggttacttaggttaccgtggggtacgggaaggtaacggggagggtaaccggttaaggttacgggttaaaccggtttgggggtttacgggtacgggggtacccggtaacggggg

SEQ ID NO: 268417 - DNA, 637 bp, Homo sapiens
  misc_feature: GYAE6OF02FKD9G.28.57.F02.1.454.CMB.1.raw
  modified_base (490)..(490): a, c, t, g, unknown or other
  misc_feature (490)..(490): n is a, c, g, or t
  modified_base (536)..(536): a, c, t, g, unknown or other
  misc_feature (536)..(536): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtgcagcctcgtggattccaccttcagttatttatgctatgcacgtcgggtcccgccgaggtcctccgaaggggaagggacgtggaatatgtctcgaggttattagaagttaatgacgtaaataacattaagtattagtacgactaaactcgtaggtaggaagggcagtatttccaacctacgtacctacccgagggaactaacgttaaccaaagtaaccacgtactgtaattccgttanaaagtcggcacgtccgtagaacgacgtcgtagaacggacacgggtnttacggtattacgtttacgtagggtaggggaaggtaacgggaggtacggtaagttacggggtaaacggttgggggttacggtaccggggacggtaacgggg

SEQ ID NO: 268418 - DNA, 642 bp, Homo sapiens
  misc_feature: GYAE6OF02G3EPC.28.57.F02.1.454.CMB.1.raw
  modified_base (305)..(305): a, c, t, g, unknown or other
  misc_feature (305)..(305): n is a, c, g, or t
  modified_base (417)..(417): a, c, t, g, unknown or other
  misc_feature (417)..(417): n is a, c, g, or t
  modified_base (483)..(483): a, c, t, g, unknown or other
  misc_feature (483)..(483): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtcgcagcctctggattccaccttcagttatttatgctatgctacgtcgggtccnccgaggtcctccgaaggggaaggactaggaatagtgtctcgtaaggtataagtaagtaatgaacgtaaataacataattattaatagactaaactcgtaggtaggaacggtnagtacttaccactatcctacgaaggactaacgttaccaaagaaccacgcttacgtaactcgttaanaaacggtcggactacgaccgtaggacgacgtacgtagggaacgaccgaacgggtcttaagtattaacgttacggtcgggttagggaaggtaagggaagtacgggttaaggttacgggtaaacgggtttaggggttcggtaccggggacgtaaccggggg

SEQ ID NO: 268419 - DNA, 838 bp, Homo sapiens
  misc_feature: GYAE6OF02HVPI8.28.57.F02.1.454.CMB.1.raw
tcagagtacgctatcacgaccggtgctcgatttagctcgatatagttgggtcgtgggagaggagcccccgccctgggtttcccaggtgttctcatttggtggactcagcactgcgacacagaagagtcagtgacggaggtttgggctggagtcgttgggttttccttgttgcttaattttttaaaggcgtcctagtgtgaggtgcagtcgtggtcggagtcgtgggggaggtcttggtccagccgtcggggggtccctggacgtaccgtctaccgtgtcgccacgtccttacgtaggtacttacctaccttcgaagttactttagtcggtaccttaacgtcgtacctaaccggttcggggtacccgtccgaacggtccgttacccggaaagggggtaaccgggtaccgttaggtaaacgtttaagttcggttaccgttacggtaagggtttaacgttaggtaaaaggttaagtacggtaacggtaaaattaacgtaagtttaacgtttaagttaacttacggtaacctaaaaccgttcttaagggtacggtaaaacgggtccgtaaggtacctttacccgaaccttaaaccgtcccgttaaccgaacggtaaacctttaaacgtaccgtaaacgtaaccgtaaccgttacgttaagttacttacgttaactaaaggtcggacctacgggtaaccgtaggtaacgacggtacgtaacgggtaagtaaccggacggttcgttaggttaactttacggtaccggttggaagggtacgacgggttaacggtacggttagttacgggtacggttacgggttacgggtggggtaccgtaacggg

SEQ ID NO: 268420 - DNA, 608 bp, Homo sapiens
  misc_feature: GYAE6OF02HHBVB.28.57.F02.1.454.CMB.1.raw
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcgttggtccagccgtgggggggtccctgagactctcctgtgcagcctctggattccaccttcagttatttatgtctatgcacgtgggtccgccgaggcctccgaggggaagggactaggaatatgtctcgtaggtattagaagtangacgaataacatatattatgacaactctgtaggaaggcagattcactatcctaccgaggactactaccaagacncgactgtactctaacaagtcggacacgtcgtagagacgtcgtagaccggacgacgggtcttagttagttacgttacggtgggtaggggaaggtagggtacggtaacggttaaggtttacggggtaaaccggtttggggggtttacgggtacggggggaccggtaacgggggg

SEQ ID NO: 268421 - DNA, 774 bp, Homo sapiens
  misc_feature: GYAE6OF02GRUG1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtgggggtccctgagacgtctcctgtcgcacgcctcgtggatttccaccttcagttattttaatgcttaagtgcctacgtcggggtcccgaccgacgggccttcccggaaaggggaacgggactaggtaaatatgtcctacgaagggttattaaggaagtaacgtgaacgtaaataaacgaattaattaagttaactagaactaaaacgttctagggtaagaaacgggtactaagtacgttaccaaccgtaacttccgtaccgtaaacgggtaaacctaaacgtttaacccgaaaacgtaaacctaacgtaccttaagttaacttaccttaaagtaaaacggtacgggtaacgaacgtacccgtaggtaacgaacggtaccgtaagggaaccggaaaccgtaaccgggtacgttacgttaacgttacgtttaaccggtagggttagggtaacgggtaaagggtacgggtaacgggttaaacggtttacgggttaaacgggtttacgggggtttacgggttaaccggggggtacccggtaaccgggggg

SEQ ID NO: 268422 - DNA, 605 bp, Homo sapiens
  misc_feature: GYAE6OF02G1II6.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggttgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtccnccaggcctccgagggacggactggaatagtgtctcgaggtattagaagtatgacgaataacatattatttatgactaaactctagtaggaaggcagtattacacctatcctaccgaacgggtaactaaacgttaccaaagaaccacgtacttacgtaacttacttaacgaaagttcgggactacgccgtagacgagtcgtaggacgacgacggcgtagtattattacgtggtagggaaggagggtaggacggtaagttacgggaacggttaggggttcgggacggggtaccgtaggggtcccgg

SEQ ID NO: 268423 - DNA, 554 bp, Homo sapiens
  misc_feature: GYAE6OF02FHM4L.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctatgcactgggtcccgccaggctccgaggggaaggactgggaatagtgtcctcaggttattagaaagtaatgacgaaataacatatattatgacaaactctgtgaagggcagattcacctatctaccgagggacaacttaccaaagaaccacgctagttatcttacaagtgggacagctagagagcgtagagacgacgtctagtatatacgtggtagggagaggacgaggtagttaggaacgttagggttcggtaggggacgtaacgggg

SEQ ID NO: 268424 - DNA, 877 bp, Homo sapiens
  misc_feature: GYAE6OF02IFU7V.28.57.F02.1.454.CMB.1.raw
  modified_base (293)..(293): a, c, t, g, unknown or other
  misc_feature (293)..(293): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtcctagtgtgaggtgcagctggtggagtcgtgggggaggcgttggtccagccgtggggggtccctggagactctcctgtgcagcctctggacttccgtaccttctagttattttangcttatgctacgtcgggttcccgccacggcctaccggaagggaacggtcgtagtaacgtagtgtacttacgaagggttaatttaaagaaaggttaagtacggaacgtaaaacgttaaacctaaagtttaatttaaagttaacgttacgtaaaccgttaaaaccttaggtttaacggttaacggggaaaacggggtaccgtaaaccgggttaaactttaaccccgtaaaccccgttaaaccgtttaccccgtaaaccccggggttaaagggttaaacccgtaaaaacggtttaaccccggaaaacggtaaacccgtaaacccgggttaaccgtttacgtttaaaccttacccgtttaaacgtaaacggtaccggggttaaccaaccggtacccggttaacggaacggttagtaacccggttaagggaaaccgggtaaccgtaaccgggtacgttaacggtttaacttaacggttttaccggtagggtaacgggggtacgggtaaagggtacggtaacgggttacggtttaaacggggtacgggtttaagggggtttcggtacggggggtaccgttaacccggggg

SEQ ID NO: 268425 - DNA, 751 bp, Homo sapiens
  misc_feature: GYAE6OF02IT3OS.28.57.F02.1.454.CMB.1.raw
  modified_base (381)..(381): a, c, t, g, unknown or other
  misc_feature (381)..(381): n is a, c, g, or t
  modified_base (456)..(456): a, c, t, g, unknown or other
  misc_feature (456)..(456): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtcccctggagtactctcctgtgcagctctggattcaccttcagttatttatgactatcgacacgtcgggtacccgccgaggcctccgtaaggggaagggtaccgtaggaattacgtgtctacgtagggttaattaaaggaaagttanaggtaacctaaagttaaacaacgttaatttaatttagtcgaaactaaaccgtttacttaggtagggaaacgggtntaaggtactttaacccaacgtaactccggtaacccgaagggtaaaccttaacgttaccgaaacgtaaacccgaccggttacgttagtttaactcccgtttaaagaaacggttccgggacttaccggccttaaggacgttagacctgggtaaaccgaccggtaacggccgttagttaagttaacgttacggtaagggtagggaacggtaagggtacgggtaacgggtttaagtttaacgggggttaaacggttttacgggggtacgggggttaccggggacccggtaaaccggggg

SEQ ID NO: 268426 - DNA, 720 bp, Homo sapiens
  misc_feature: GYAE6OF02H9OCN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgtctatttttaaaggtgtccagtgtgaggtgcagctggtggagtcgtggggggagtcgttgggtccacggtccgtggggggtcccctggacgtactctccgtgtgcagcctgtggtacttcctacttctagttatttatgtacttagtgacacggttcgggtcccgacccgaggtccgtaccggaaggggaacggacgtaggaatactgtctagtaaggttataagaaagttagagaacgtaaataaactattaattaattagtactacgtaaatcgtaggaaggaagggtacaagtacttacaaccgattccgaacggtaaggtaactaacgtaaccaaacggtaacgtacgtcttaacgtattacgtaacgaaaggtcgggcttaacggtccgttaggaagtcggtacgttaacgggacgtaccggaacggttctaagttaaccgttacggtttacggtcgggggtaagggaagtaacgggtaacggtaccgggttaggtttaccggggtaaacgggttttagggggtacgggtacccgggggtacggtaaccgggg

SEQ ID NO: 268427 - DNA, 882 bp, Homo sapiens
  misc_feature: GYAE6OF02F0HFO.28.57.F02.1.454.CMB.1.raw
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagcgtggttttcgttgttgctattttaaaggtgtccagtgtgaggtgcagctggtggagtcgtgggggagtcgttggtccagccgtggggggtccctgagactctctgtgcgagcctcgtggattcgaccttcagttactttatcgtctagtagccacgtcgggtcccgcccgagggtcctccgaaggggaacgggaccttaggggaaattagtcgttaccgtacggtaagggttaacgtttaaggtaaaaggttaaacgttcggtaaccggtaaaactttaaaaccgtaagtttaaagtttaaacgtttaactttacgggtaaaccttaaaaaccgtttccggtttaaggggttaacggtaaaacggggtcgtaaacgggttacttttaacccgaacccgttaacgttaccccggtaacccgtaaacgggggaaacctaaaaccgtttaacccgaaaacgtaaaaccgtaccggttacgttaaccgttaacgtttacccgtttaaacgtaaaccggtttaggggacccacggtaccgttacgggtaaacgtacgtcggttacggaaacgggtacccgtacgggtacgtttacgttaacggtttaacgtttaaccgggttagggttacggggtaaacggggtagggtaacggttaaacggggttaacggtttacgggggttaaaaccgggtttacgggggtttcgggtttaccggggggggacccggttaaaccggggg

SEQ ID NO: 268428 - DNA, 660 bp, Homo sapiens
  misc_feature: GYAE6OF02IWB2I.28.57.F02.1.454.CMB.1.raw
  modified_base (175)..(175): a, c, t, g, unknown or other
  misc_feature (175)..(175): n is a, c, g, or t
  modified_base (332)..(332): a, c, t, g, unknown or other
  misc_feature (332)..(332): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtntccagtgtgaggtgcagctggtggagtcgtggggggaggcttggtccagccgtggggggtccctgagactctcctgtgcagcctctggattcaccttcagtatttatgctatgcacgtgggtcccgccgaggcctccgaggggaagggactggaatntgtctgaggtatagaagtatgacgaataacatattattatgactaaactctgtaggaagggacagtactttccaacctataccgtacgaagggtaactaacgttacccaaaaggaaccacggtacttagttacttaccttacaaacggtcgggacgtaacgcccgttaggaacgaggtacgtacgggaaacgggtaccggaaccggtagttagttacgttaagttttaccggtgggttaggggaaacgggtaagggtagggaaccgggttaaggtttacgggtaaacggttaggggggtttcggttacggggggaccgtaacgggggg

SEQ ID NO: 268429 - DNA, 578 bp, Homo sapiens
  misc_feature: GYAE6OF02G9YKO.28.57.F02.1.454.CMB.1.raw
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
  modified_base (481)..(481): a, c, t, g, unknown or other
  misc_feature (481)..(481): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctggagactctcctgtgcagcctctggattccaccttcagttatttatgctatgcacgtgggtcccgccaggcctaccgaggggaaggacgtaggaatagtgtctacgaggttaattaagaagtatgacgaataacatatatatgactaaactctagtagaagggcaagtacttcactactcctacgaaggtactaacttaccgaanaaccncgtacttgtactcttacaagtggacagtacngagagcgtagacgacgacgctagtattagttacggtggtaggagaagggacgaggtaagttcgggaacggttaggggtcggtacgggcggtaacggg

SEQ ID NO: 268430 - DNA, 560 bp, Homo sapiens
  misc_feature: GYAE6OF02FMPQS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggaggcttggtccagccgtggggggtccctgagactctcctgtgcagcctctggattcaccttcagtatttatgctatgcactgggtcccgccaggcctccgaggggaagggactaggaatatgtctcgaggttattagaagtaatgacgaataacatatattatgacaaactctgtgaagggcagtattcacatctacaggacaacttaccaaagaacacgctagtactacttacaaatgggacagcctgagagcgtagaggacacggtctagtattattacgtggtagggaggaggagacgggtaagttagggaacgttaggggttaggttacggggacggtaacgggg

SEQ ID NO: 268431 - DNA, 634 bp, Homo sapiens
  misc_feature: GYAE6OF02FYDQZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagacctctcctgtgcagcctctggtattcaccttcagtactttatgcttatgctacgtgggtcccgaccgtaggcctccgaggggaacggactaggaatagtgtctgaggttatagaagtatgacgtaataacattatattactagactaaacgtctaggtaggaacgggtacaagtacgttaccaccgtacttacccgtaccggaagggtaacctaaacgttaacccaaacggtaaccgaacggttcttagttacttaccgtttaacaaaggttcggacctaacgggtcctagggacgtagtcgtagggacggtacgtacggtcttaggtacttagtagtggaggaggaggagtacgtagtacggaaggttgggtcggtagggcgtacgggg

SEQ ID NO: 268432 - DNA, 740 bp, Homo sapiens
  misc_feature: GYAE6OF02F5P3O.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggtccagccgtggggggtccctgagactctcctgtgcagcctctggattcaccttcagttatttatgcttatgctacgtcgggtcccnccgaggcctccgaaggggaacgggactggaattatggtctacgaggttattagaagttaatgacgtaaataacattaattattatcgactaaacttctaggtaggaagggcaaggtacttaccgaccctatcctaacccgaagggtaacctaaactttaacccgaaaggaaaccctaacggttaccttacggtttaacttaccctttaacgaaaacggttggggaccctaacggtacccgttagggaacggacggtaccgtaacggaacgggaactacgggtaccttagttaacgtttaacgttttacggtaacgggtagggggtaacgggtaacggggtagggtaaaccggggtttaaggtttaacgggggttaaaccgggttttaggggggtttacggggttaccggggggacccggttaaaccgggggggg

SEQ ID NO: 268433 - DNA, 717 bp, Homo sapiens
  misc_feature: GYAE6OF02GQTDO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttgggtccaggccgttgggggggtccctggagactctcctgtgcagcctctggattcaccttcagttatttatgctatgcacgtgggtccgccgaggcctccgaaggggagggactggaatatgtctcgtaggtagttaagaagtaatgacgaataacataatattatgactaactctaggtaggaagggctaagtattacctaacctattccctacccggaagggaactaaacgttcccgaaacgtaaacccacggtaccttacggttacttaccgtttaacgaaaacggttcggggaacctacggtaccggttaggaacgtacggacggttaacgggacgggaaacccgtaacgggtccgttaggttacttacgtttaccgggtgggttaacggggaagggtaacggggtagggtaaccgggttaaacggtttaacgggggtaaacggggtttagggggtttacgggggttacggggggtaacccgtaaccgggggggg

SEQ ID NO: 268434 - DNA, 657 bp, Homo sapiens
  misc_feature: GYAE6OF02GUN99.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagcctggggggtccctgagacctctcctgtgcagcctctggattcaccttcagttatttatgctatgcacgtgggtcccgccaggcctccgaggggaacgggctagggaatgtcgtctcgagggttattaggaagttaatggacgaaataacataatattatagacaaacttctaggtagtaagggctaaggactttaccacctattcctacccgaggggaactaacgttaccgaaagaaccaacggtacttaggtaacttacgttacaaagtcgggacaaggtcctggacgagtacgtaggaacggtacgaccggtactaggttacgttaacgtttacggtagggtaggggtacggaacggggtaacggacgggttaaacggtttagggaaaccgggtttagggggttacgggtccgggggaaccgtaacgggggg

SEQ ID NO: 268435 - DNA, 786 bp, Homo sapiens
  misc_feature: GYAE6OF02IK5NU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgcttatttttaaaggtgtccagtgtgaggtgcagctggtggagtcgtggggggaggcttggtccagtccgtcggggggtccctggagactctcctgtgcagcctctggattccacctttcagttatttatcgcttatcgctacgtcgggtcccgccgacggccgtaccggaaggggaacgggtacgtaggtaacttagttcgtacgtacgtaaggttaagttaaggtaaagttaagtacggaacgtaaactaaacgtaattaactttaagtttactacgtaacctaaaacttcgttaggtacggtaaacgggctaagttactttacccgaacctacgttacccgtaacccgggaaaggtaacccttaaacgttacccgaaaacggaacccgtaacgttacttacgttaacttaccgtttaacgaaagggtccgggtaactacggtcccggtaggaaggtacgtacggtaccggaaacgggacccgtaccgggttacttaagttacgttaacgtttacggtaacggggtagggtaaggtaggggtaacggtaacgggtttaacgggttacgggttaaaccgggtttggggggtttaacgggaccggggggttacccgtaaacgggggg

SEQ ID NO: 268436 - DNA, 612 bp, Homo sapiens
  misc_feature: GYAE6OF02H41QO.28.57.F02.1.454.CMB.1.raw
  modified_base (175)..(175): a, c, t, g, unknown or other
  misc_feature (175)..(175): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (416)..(416): a, c, t, g, unknown or other
  misc_feature (416)..(416): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtcgtgggggaggcttggtccagcctgggggggtccctgagactctcctgtgcagcctctggattcaccttcagtatttatgctatgcacgttggtcccgccgaggccttccggaggggaagggactagggaatatggtctacgaggtaattagaagttaagtagacgaaataacatattattangtacaactctgtagaggnagnttcacatcnccaggactactaccaagaacacgactagtacttacttacaaagtcggacacgccgttagaacgtagcgtaggacggaacgcccggattacggtattaacgtttacgtgggttaaggggaggtaagggacggtagggtaaacggtttcgggtaaaacggtttcgggggtttagggtacgggggtcccggtaaggggg

SEQ ID NO: 268437 - DNA, 625 bp, Homo sapiens
  misc_feature: GYAE6OF02JQQPM.28.57.F02.1.454.CMB.1.raw
  modified_base (182)..(182): a, c, t, g, unknown or other
  misc_feature (182)..(182): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
tcagagtacgctatcacgaccggtgctcgatttagctcgatatagttgggtctgggagaggagcccccgccctgggtttcccaggtgttcctcatttggtgatcagcactgcacacagaagacgtcatgaccggtagtttgggctgagcttgggtttttccttgttgcttatttttaaaggngtccagtgtgaggtgcagctgggtggagtcgtggggggagtcgttggtcccaggcccggttggggggtcccctgaggaccctcgtccctggtgccaggccctctgggatttcacctttcagtatttatnggctatggcactgggtccgccaggctccagggaggactggaatangtctcaggtattagagtatgcgaattaacatanattangnaaactcngtnaagggcagattcaccagtctaccaagggtaccaaattacccaagaaccacgtacttagtactacgttcaaaattggggccagccctagacgacgaccgtgacggaccaacgggtccttaggttaacttacgttaacgtaggttacggggtaacgacggggtaacgtacgggaaacgtttcgggaaaccgtttacggggtttacggagggggtaccccgg

SEQ ID NO: 268438 - DNA, 767 bp, Homo sapiens
  misc_feature: GYAE6OF02I0X6K.28.57.F02.1.454.CMB.1.raw
  modified_base (261)..(261): a, c, t, g, unknown or other
  misc_feature (261)..(261): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaagatgtcagtgtgaggtgcagcgtggtggagtcgtgggggaggcttggtccagccgtggggggtccctggacgactctcctgtgcagcctntggattccgaccttcgagttactttagtcgtacttagtcgactacgttcggggtaccctccggtacgggtcctaccggaaggggaacgggacgttagggaattagtcgttctcggtaagttaagttaggaaagttaactacggaacgtaaataacctaattaacttaagttaatacgtaactaaacgttcgtagggtacggtaacgggtactaaggtacctttaccaacccgtattacccggtaccggaaacgggtaaaccctaaagtttaccccgaaaagtaacccgtaaccggtatttacgtaaactttaccgttaacgaaaacgggtttccgggacgtaaccgtaccgtaaggggacgtaccgggtcctaaggggaccggaaccgtacggggtaccttaggtaaccgtttaacgttacgggaggttagggggaacgtacgggtaacggtacgggttaacggtttagggaaacggttgggggtttaccggacggggtaaccggg

SEQ ID NO: 268439 - DNA, 660 bp, Homo sapiens
  misc_feature: GYAE6OF02H7H35.28.57.F02.1.454.CMB.1.raw
  modified_base (308)..(308): a, c, t, g, unknown or other
  misc_feature (308)..(308): n is a, c, g, or t
  modified_base (364)..(364): a, c, t, g, unknown or other
  misc_feature (364)..(364): n is a, c, g, or t
  modified_base (563)..(563): a, c, t, g, unknown or other
  misc_feature (563)..(563): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgtcttatttttaaaggtgtcagtgtgaggtgcagcgtggtggagttcggtgggggaggcgttggtccagccggtcgggggggtcccctggacgtactctccgtgtgcacgccctgtggacttacctccctttcagttatttactgntactgcacgtccgggtccgccgacggcgtccggaaggggacgggacgtaggaattntcgtctgaggttatagtaagtatagacgtaaataataattaattattatagtactaacttcgtgtagacgggactacgtataccacgtactccgtacgaaggtaactaacgtaccaaaccgtaacgacgtacttagtaacgttacttacgaaagtcgggactacgtccgtagacgtaacgtcgagacggaccgacggtnttagttacttaggtacgtggggtaggtaacgggaggtaggtacggttaaggtacgggtaacgggtttggggttacgggaccgggtaggtacccgggg

SEQ ID NO: 268440 - DNA, 639 bp, Homo sapiens
  misc_feature: GYAE6OF02HR1KA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaaggtgtccagtgtgaggtgcagctggtggagtcgtgggggaggcttggtccagccgtggggggtccctgagactctcctgtgcagcctctggattcaccttcagttatttatgtctatgcacgtgggtcccgcaggcctccgagggaaggctggaatatgtctcgaggttattagaataatgacgaataacatatattatagacaaactctagtaggaagggactagattacacctatcctaccgagggaactaacgttaccaaacgaaaccgaccgtacgttagtaactttacctaacgtaaagtcgggaccaacggtccctagggaagacgacgtaggaacgggaccgaaccgggtacttagttaagttacgtttacggtgggttacgggaagggtagggaagggtacggtaaaggtttcgggaaaccggtttagggggtttacgggtcgggggaccgtaacggggg

SEQ ID NO: 268441 - DNA, 823 bp, Homo sapiens
  misc_feature: GYAE6OF02GA615.28.57.F02.1.454.CMB.1.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctattttaaaggtgtcagtgtgagtgcagctggtggagtcgtggggagcttggccagccgtggggggtccctggagactctcctgtgcngcctcgtaggtattccaccttnagttatttatgctgttgctacgtcggtccgcccgaggcctaccgaggggaagggactagggaattagtggtcctagtaggttaagtttaaggaaacgttaagtcggaacgtaaataaacattaatagtttaacagtaactaaactcgttaggtacggaagggtacacggttaactttaccaaccttagttaccccgtaccgaaagggtaaccctaaaacgttaacccgaaaacggtaaaacccgacggttaaccttagggtttaaacttcccctttaaaaggaaaacgggtttcccggggtaaactaaacggggttaccttaaagggtaaccggtaaaggtacccgttcgggtaaaccgggtaaccggaacccggttaccggggttaacttagggttttaaacgtttaaaccggtttaccgggtaacgggggttaacgggggtaaacggtaaggggttaacccggggttaaaccggggttaagggttttaaacggggggtaaaccggggttttaacgggggggttttacccgggggaaccggggtaacccgggg

SEQ ID NO: 268442 - DNA, 719 bp, Homo sapiens
  misc_feature: GYAE6OF02H76Z7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttttaaaggtgtccagtgtgaggtgcagctggtggagtcgtggggggaggcgttggtccagccgtggggggtccctggagactctcctgtgcagcctcgtggattccacctttcagttatttatgctatgcacgtcgggtccgccgacggcctccggaaggggaacgggacgtggaatagtgttctcgtaggttaattaggaaagttaatcggaacgtaaaataactaattaattaatttagtagtaacctaaaacttcgttaggtaggaaacggggacaagtaacttacccgaacctaacttcccgtaccgaacgggaaactaaacgttaacccgaaaagaaacctaccgtacgttaagtacttaccttaacaaacggttagggcctacggtaccgtaggaagtacgtccgtagggaacggaccgtaacggtgttaacgttacgtttaacgtttaccggtgggtaacggggtaggaaagggtacggtacggttaaggtttacgggaacgggtttagggggtttacgggtaccgggggacggtaacggggg

SEQ ID NO: 268443 - DNA, 832 bp, Homo sapiens
  misc_feature: GYAE6OF02ITV2M.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtcgtgggagaggagcccccgccctgggtttcccaggtgttctcatttggtgatcagcactgcacacagaagagtcatgacggagtttgggctgagctgggttttccttgttgcttattttttaaaggtgtccagtgtgaggtgcagctggtggagtcgtgggggagcttggtccaggccgtggggggtccctgagactctcctgtgcagcctctggattcaccttcgagtattactgctatgacacgtgggtcccnccgacgggcctccgagggaacgggactagggtaaatattcggttaccctacgaaggttacgttaaaggtaacgtaaacgtcggaaccgtaaaacgtaaaaccgaatttaagttaaactttaacgttacggtaacctaaaaaccgttccggttaggttaaaggtaaaccgggggtaacaagggtttaaacctttaccggtaaacccctaacgtacccgtaaccccggtaacgggggtaaacctaaaaccgtttaacccgaaaacgtaaaacccgaaccgggtacttaacggttaaccttaccgttaaacgtaaaggttcgggaactaccgggtaaccctaggtaaagtaccgtagtacgggaaagggtaaacgaccgggtacgttaggtttaacgttaccgttttaaaccgtggggttacgggaaacgggttaaagggaacgggggtaaccggttaaaaggtttacggggttaaaaccggttagggggttttacggggtacgggggttaccccggtaaaccgggggg

SEQ ID NO: 268444 - DNA, 813 bp, Homo sapiens
  misc_feature: GYAE6OF02G9Z7M.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtgggtagtttggggggaggtcttggtccagccgtgggggtccctgagactctcctgtgcagcctcgtggacttcaccttcagttatttatcgtacttagtgctacgttcgggtcccgtccgaggtccgtccgaaggggaacgggacgtggaaattagtcgttcctacgaggtttaattaaggaagttaacgtgaacgtaaactaaacgtaattaattaagtttaatacgactaaaaccttcgtaggtaggtaaacggggctaagtacttaccgacctactaccgtaccgagggtaaactaacgttaacccgaaaggaacccaccgtacgttacggttaactttaccgttaacgtaaacggtcgggtaccgtaacggacccgttagggaaccggtacggtaccgtaacgggtaacggacccgggtaccggtaccgtttaagttaaccgttttaacgtttaaccgggttaggggtaaggggggtaagggttaaacgggggtaacgggtaaacgggggttaaacggtttacgggggggttaaccgggtttttaaacgggggggtttcgggggttaaccgggggggtacccgggtaaccggggggttaacccccggggg

SEQ ID NO: 268445 - DNA, 544 bp, Homo sapiens
  misc_feature: GYAE6OF02JYT15.28.57.F02.1.454.CMB.1.raw
  modified_base (303)..(303): a, c, t, g, unknown or other
  misc_feature (303)..(303): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (399)..(399): a, c, t, g, unknown or other
  misc_feature (399)..(399): n is a, c, g, or t
  modified_base (407)..(407): a, c, t, g, unknown or other
  misc_feature (407)..(407): n is a, c, g, or t
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccaggccgtggggggtccctggagactctcctgtgcagcctctggattcaccttcagtatttatgctatgcacgtgggtccnccagggctccgagggaggcgtaggaatntgtctacgaggtatagaagtaangcgtaaatacattatattatgactaaatctggtagagggcaagtntcacatcncaggactatacaagaacncgactntatcttanaagtggtacncgtactgagacgtntgaacggacacggntacgtatagtacgtggagggagacggagacggtagtagggagttaggggtgtaggggtacgtacggg

SEQ ID NO: 268446 - DNA, 657 bp, Homo sapiens
  misc_feature: GYAE6OF02GM4QK.28.57.F02.1.454.CMB.1.raw
  modified_base (299)..(299): a, c, t, g, unknown or other
  misc_feature (299)..(299): n is a, c, g, or t
  modified_base (377)..(377): a, c, t, g, unknown or other
  misc_feature (377)..(377): n is a, c, g, or t
  modified_base (433)..(433): a, c, t, g, unknown or other
  misc_feature (433)..(433): n is a, c, g, or t
  modified_base (537)..(537): a, c, t, g, unknown or other
  misc_feature (537)..(537): n is a, c, g, or t
  modified_base (637)..(637): a, c, t, g, unknown or other
  misc_feature (637)..(637): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcgtcgtagctatttaagtgtcagtgtgaggtgcagctggtggagtcgtgggggaggccttaggtccagccgttcggggggtaccctggcgtactcctcgttggcgcacggtccctccttaggactttccaccttctaggttatttancgtctatcggactacggtcggtcccgcgtacggtcctaccggaggggaaggtacctaagggtaattcgtcgttaccgnggtaaggttaagtaacgggtaatagttcgaacgtaaactaacaattaagttaactntaccgtaataaacgttgtacgaggaacggtctaacgtacttacgaacctattccgaacgtaggtaactaactccaaatcgacttacgtatagttaccagtaggngcagtcaaggataggcagggactaccggtagtccgttaaggttactagtttggagggtacgagtacggtagtagggtacgttacggagggtttaccgggnggttacgggagtaacccggg

SEQ ID NO: 268447 - DNA, 841 bp, Homo sapiens
  misc_feature: GYAE6OF02FL443.28.57.F02.1.454.CMB.1.raw
tcagagtacgctatcacgaccggtgctcgatttagctcgatatagttgggtctgggagaggagcccccgcccctgggtttccccaggtgttcttccatttggttcgatcagcactgcacacagaagagtcatgacggaagtttgggctgagctgggttttccttgttgtcttattttttaaggttgtcctagttagtgaggtgcagctggtggagtcgtgggggaggtcgttcgggtccgaggccgttggggggtccctggacgtacgtcctccgtgtcgcacgtcctcgtggtacttccaccttcgtacgttagtttattcgtacttatgtctacgtcgggtcccgccgtacggtcccgtaccggacggggaacgggtaccgtagggaaagttcgtcgtacgttacggtaggttaagttaacggtaaggttaacgtaggtaacgtaaacttaaacgtaattaattaacgttagtacgtaactaaacgttcgttaggtacggtaacgggtactacgttactttacgaaccgtaacgttccccgtaacggtaaccggtaaaccttaaccgttacccgaaaacggtaaccgtaccggtaaccttaacgtttaccttaaccgttaaccgtaaacgtccggggtaacctccgtaccgtaaggtaacgtacgtaccgttaacgggaacgtaacccggtacgggtactttacgggttaacttaacggtttaccggtaacgggggttaacgggtaggtaaacgggttaacggtaacggggtttaaacggttaacgggttaaaccgggggtttgggtaaccgggttacggggaacccggttaacggggg

SEQ ID NO: 268448 - DNA, 818 bp, Homo sapiens
  misc_feature: GYAE6OF02JHEZD.28.57.F02.1.454.CMB.1.raw
  modified_base (221)..(221): a, c, t, g, unknown or other
  misc_feature (221)..(221): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgctattttaaggtgtccagtgtgaggtgcagctggtggagtcgtgggggagtcttggtccngccgtgggggggtccctggagaccgtccttccgtggttgacacggtcccttcgtcggggtaactttcccgtaccctttaccgtaaaggttttaattttacgttggtaccttaagtccggtaaccgtaccgggttacggggttcccccggaccggtaaccggggtcccttacccgggaaggggggtaaaccggggtaccttaggggtaaaacttcgtacggttcccgttacggtaacggggtttaaattaacggtaaaaggttaagtcggtaacccggtaaaattaaaccgaatttaacgtttaagttacgtaggtaacctaaacgtttcgttagggtacggtaacggggtcctaagtacgttaacccactacgtacccgtcggaaacggtactaacgttaccaaacggacctacggtacttacgttacttctaacgaaacgtgggaccaggtacccgtagacggaccgtgttacggacggtaacgcggtagttccgttaatgttaccgggttggaacgggtaacgtagggaacccggttaggtaacggttcgggtaaaacgggtttcggggtacggtaccggggaggttaaccgggg

SEQ ID NO: 268449 - DNA, 578 bp, Homo sapiens
  misc_feature: GYAE6OF02FPEYI.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagactctcctgtgcagcctctggattcaccttcagtatttatgctatgcactgggtccgccgaggctccgaggggaagggactgggaatatgtctcgaggtattagaagtaatgacgaataacatatattatgactaaactctagtaggaagggcagtacttcacctatcctcgagggaaccaattaccaaagaacacgtctagtactccttacaaagtcgggactacgcctagaagacgcgtagacggacgacggcttagtatacgttacggtggtaggggacgaggtaggaggtaagttagggaacggttggggttgggtacggggaccgtaacgggg

SEQ ID NO: 268450 - DNA, 702 bp, Homo sapiens
  misc_feature: GYAE6OF02FMDOI.28.57.F02.1.454.CMB.1.raw
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgcttatttttaaaggtgtccagtgtgaggtgcagctggtggagtcgtgggggaggcttggtccaggccgtggggggtccctgagactctcctgtgcngcctctgattccaccttcagtatttatgtctatgcactcggggtcccnccgaggtcctccgaagggaagggctggaatatgtctcgagttattagaagtatgagaataacattaataattntanactaaactctaggtaggaacgggacaaggtaacttaccaaccgtacttactacccgtaacgggaaacctaaacgttacccaaaacgaaacccgtaacggtacgttacgttaacttaccttaacgtaaaacgtttcgggaaccacggttaccgtacgtaagggagtccgtagggaaccgaccgtaccgggtactagtttaacgtaactttttacggtcggggttagggaacgggttagggaacggttaaggggtaaacttttaggggtaaaaccgggtttaggggtttcggggttacccgggggaccggttaaaccggggg

SEQ ID NO: 268451 - DNA, 853 bp, Homo sapiens
  misc_feature: GYAE6OF02FXMK4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccaggccgtggggggtccctggacgactctcctgtgcacgcctcgtggacttcaccttcagttatttatgtctatcgcacgttcggggtccctaccgacgggtccttaccggaagggggaacggggtaccgtaggggtaaactttacgttacggttccgttacggttaacgggtttaaagttttaaaggaaaagtttaaacgtacggtaaaccggtaaaacgtttaaaacctaagttaaactttaaagtttacgtaccggtaaacctaaaaacccgtttcgttacggggttaacgggaaccggggtaccgtaaacgggtaaccttttacccgaaaccctttaacggttacccctaacccggggtaacggggtaaaacccttaaaccgtttaccccgaaaaacggtaacccgtaaccgtaccgtttaagtttaaccttacccgtttaaaacctaaaggggtccgggttaaaccgcggtaccgttaggaaacgtcgtaacggttagggaaaccggtacccggtacgggtacttaacggttacttaaggtttaccggtggggtaaccgggaggtaaggacgggtaaggtacgttaacgggtagggtttacgggtgggtaccgggcgtaaccgggg

SEQ ID NO: 268452 - DNA, 669 bp, Homo sapiens
  misc_feature: GYAE6OF02GG0RC.28.57.F02.1.454.CMB.1.raw
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggtttccttgttgcttattttaaggtgtccagtgtgaggtgcagctggtggagtcgtgggggagcttggtccaggccgtgggggtccctgagactctctgtgcagcctctggattcaccttnagtatttatgctatgcacgtgggtccncaggctaccgaggggaaggctggaatagtgtctcgaggtaagttagaagtaatgacgtaataanatatatanagacaactcgtgtaggaaggctagtagtacaccgtaatccgtacgaggtaacctaacgttacccgaaaggaacctaccgacgttagttaactccgtttaacgaaacgttcggggaactacggaccttagggaagtacgtcgtaacgggaacggaacccgtacggtaacgttaggttaacctttaaggtaaccggtttgggtaaggggaaagtaccgggggtaacgtacgggggtaaacttttacggggaaacccggtttaagggggtttacgggtaccggggggtaccggaaccgggggg

SEQ ID NO: 268453 - DNA, 560 bp, Homo sapiens
  misc_feature: GYAE6OF02FLE9D.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggtttttccttgttgcttaatttttaaaggtgtccagtgtgaggtgcagctggtggagtcgtgggggagcttggtccagccgtggggggtccctgagacctctcctgtgcagcctctggattcaccgttcagttatttatgctatgcacgtgggtcccgcaggcctccgaagggaaggcctaggaatatgtctacgaggtattaagaagtatgacgtaataacatatattatgaactaactctgtaggaaggcagtattccaaccatctaccgagggaactacttaccaaagaacacgtctagtacttacttacaagtcgggacagtcctagacgagctagacgacgacgctagtatatacgtgagggagaggagtagtaggtgtaacgtagggttcggtcgggcgtacggg

SEQ ID NO: 268454 - DNA, 894 bp, Homo sapiens
  misc_feature: GYAE6OF02HJ9O0.28.57.F02.1.454.CMB.1.raw
  modified_base (185)..(185): a, c, t, g, unknown or other
  misc_feature (185)..(185): n is a, c, g, or t
  modified_base (364)..(364): a, c, t, g, unknown or other
  misc_feature (364)..(364): n is a, c, g, or t
  modified_base (754)..(754): a, c, t, g, unknown or other
  misc_feature (754)..(754): n is a, c, g, or t
tcagagtacgctatcacgaccggtgctcgatttagctcgatataggttggggtctgggagaggagcccccgccctgggtttcccaggtgttctcatttggtgatcgagcactgcacacaacgaagagtcatggacggagtttgggctgagcttgggttttccttgttgtacttagttttaaaggngtcctagtgtggaggtgcagcgtgggtggtaggttcggtgggggagtcgttggtacccgtacggtccggttcggggggtacccctaggacggtaccttcgttccgtggttcgaccgtaacgtccgttacgttggttacctttacccgtaacccgttttataaacggtttaagttttacnccggttaacttaagtccgaccgttaacggtccggggtcccgtacgaccggttaccgaccgggtaaaggggtaacgggtactaacgggtaacttacgttccgttaaccgttacggttaaggttaacgttaaacggtaaagttaacgtacggtaacgtaaaaacgtttaacctaagtttaaactttaagtaaacgtaaccgtaacctaaaacgtttcgtaagggtaacggaaaggtccggtaagttaccgtacctaacccgttacgtaccgtacccgggaaagtaaacccttaacgtaaccggaaaacgtaactaccgttacggtttactaaactttacggtaaactacggtaacggtccaacccgttagaccggtaaacgaggttaaccgngggaaccggtaacgtacgttcgtttaagttaacgttacggtttacggtgggtaacgggtaaaggtacgggtacggtaaggtttacgggtaccgggtaaaacggtttaccggggtagggtcccgggtaacgggttaacggg

SEQ ID NO: 268455 - DNA, 796 bp, Homo sapiens
  misc_feature: GYAE6OF02GNHLQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccaggccgtcggggggtccctggagactctcctgtgcagcctctggtattcaccttcagttatttatgctatgctacgtcgggtcccgccgaggcctccgaaggggaacgggactagggaattagtgtctacgtaaggttaattaaggaaagtaataggacgtaaattaaacaattaattaattaatacgtaacctaaacttcgttaggtaaggttaacgggcaagtactttacccaactacttccgtaaccggaacgggtaacctaaactttaccccgaaaacggaaaccctaccgtaccgtttagttacgtttaccttaacgtaaaacggtcgggggtaaccaccgggttcccgttaacgggaacggtaacggtcccgttaaggggaaacccgggtaacccgtaacgggttaccgtttaaggtttaactttacggttttaacggtttggggggttaaaggggtaacggggtaacgggggaacgggttaaccggggttaaaggttttacgggggaaaccgggttttagggggggtttaccgggggtttacggggggaccccgggtaaagggggg

SEQ ID NO: 268456 - DNA, 770 bp, Homo sapiens
  misc_feature: GYAE6OF02JCFPQ.28.57.F02.1.454.CMB.1.raw
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttccttgttgctattttaaggtgtccagtgtgaggtgcagctggtggagtcgtgggggagcgttggtccgagccgtggggggtccctgacgctctcctgtgcagcctcgtggacttcaccttcagttatttangtctatcgcacgtcgggtccnccgaggcctaccgaggggaaagggctacggaatacgtgtactacgtaggttaagttaagaagtaatacgacgtaaactaacataagttactagtacgtactaaaactcgtagtaggaagggactaagtacgttaccaacgtacttaccgtaccggtaacggtaaactaaacgttaaccaaacggtaaacccgtacgttaccgttacggttaaaccttaacccgttaacgtaaaacggttcggggaaacttacccggtaccgttacggaaacgggtaccgttaacggttaacgggaaccgttaaacggacccgggttaagtttaacccggtttaagtttaaccggtttaacgggttaggggttaaacgggttaccgggaaagggtaaccggtaaggggtttaaacggttacgggggttaaacggtttacggggggtgggttaaccgggggtaccggttaaccggggg

SEQ ID NO: 268457 - DNA, 607 bp, Homo sapiens
  misc_feature: GYAE6OF02GPJZW.28.57.F02.1.454.CMB.1.raw
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatgcactcgggtccgccgaggcctccgaggggaaggactaggaatatgtctgaggtattaagaataatgagaataacatatattatgacaaactctagaggaacggnagtattaccacctatcctaccgaagggtaacaagttacccaaagaaccacgtactagtatccgttaacaagtggacagtcctaggaagtacgcgtaggaacggacgacggtgttagtattaacgttacgtgggtaggggtaacgagggacggtacgggtaagttacggggtaaacggtttgggggttacgggtacgggggaccgtaacggggg

SEQ ID NO: 268458 - DNA, 910 bp, Homo sapiens
  misc_feature: GYAE6OF02GCNIO.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttcttgttgcttattttaaaggtgtccagtgtgaggtgcagctgggtggagttcgtgggggaggtcgttggtcccgaggtcccggttcgggggggtcccctggacgtaccttccttccgttggtgccgacgtcccttcgtggtacttcctaccctttctacgttattttatgtaccttagtcgtacctaccgttcggggtcccgacccgtacggcccgtaccggaagggggaacggggacgtacggtaaagttagttccggttactacggtaaggtttaagttaaacggtaaaagttaacggttacgtaaacggtaaaactttaaacgtaaacgtttaaatttaagtttaacgttaacgtaacccgttaaaacgtttcggttagggttaaacgggtaaacggggtacgttaacgggttaacctttaccccaaacccgtacgtttaacccggttacccggaaacggggttaaaccttaaaccggtttaaccccgaaaaacggtaaacccttacccgggtactttaacgggttttaaaccttacccggtttaaacgaaccgggttacgggaccgtaaccggtacgttacggagtaccggtacgtagggaaccggtaccgacggggttacttagtttaacgttacgtttaacgggttgggtaaggggtaaccggtaagggtaaccgggttaacgggttaacggttaacggggtaaaaccgggttttgggggtcggggttacgggggtacccggtaacggggg

SEQ ID NO: 268459 - DNA, 832 bp, Homo sapiens
  misc_feature: GYAE6OF02HY2F6.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcttggggtttttccttgttgcttaatttttaaaggtgtccagtgtgaggtgcagctgggtggagtcgtgggggaggtcttggtccaggtcccggtgggggggttccccctagggtacggtaccttccgtcccgttggtacgcctacggtcccctcgttaggtactttccctaccctttacgaagtttattttaatcgtccttaatcggtaccgtaccggttccggggtcccgcccggtacggtcccgtacccgggaaagggggaacggggtaccgttagggaacttaacttcgtcttacggtagggtttaaacgttaaggtaaacgttaagtacggaacgttaaacgtaaactaatttaaattacgtttaactagtaaacctaaacgtttcgttacgggtaaggtaacggtaccgtaagtaaccttacccgaacctacttaccgaaccggtaacgggtaaccttaaacgtaccgaaacgtaaccgtaacgtcgttactacgttacctaagtaaacggtcgggaccgtacgtccgtaagacggtaacgtcgtacgggacggacgtacggtaccgtagtttaacgttacgtttacggtgggtaaggggacggtaagggtaacggccgggttaaaggttacgggttaacgggttaggggtttacgggtaccgggggtacggtaaccgggg

SEQ ID NO: 268460 - DNA, 781 bp, Homo sapiens
  misc_feature: GYAE6OF02IIQ3M.28.57.F02.1.454.CMB.1.raw
  modified_base (191)..(191): a, c, t, g, unknown or other
  misc_feature (191)..(191): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttcctgttgctattttaaaggtgtccagtgtgaggtgcagntggtgagtctgggggagtcttggtccagccgtggggggtccctgagactctcctgtcgcagcctctggattcgaccttcagttatttagtgctagtgctacgtcgggttccgaccgtcggacctccgaaggggaacgggacgtagggtaaacttagtcgtcgttaccgtaagggttacttaaggtaaacgttaagtacggacgtaaataaacgtaattaagtatttacgtacggacaaaacgttcgttagtaggtaacgggtactagtaacgttaccaacgtactaccgtccggtaaacgggaactaagttacccgaaaacgtaccgtaacccggtacgttaggtttacttacgttaaccgtaaaacggttacgggaccgtaacggtacccgttaaggtacggtacggtacgttacgaaaccgggtacgtaacccggggtaagtttacggtaccgtttaaactttaaccgggttacgggttagggggtaaacgggtaacgggttacgggtaacggttaaacgggtttacgggtaaaccggggttttaagggggtttaccgggttaaccgggggtaccgggtaaccggggg

SEQ ID NO: 268461 - DNA, 666 bp, Homo sapiens
  misc_feature: GYAE6OF02ISBY6.28.57.F02.1.454.CMB.1.raw
  modified_base (256)..(256): a, c, t, g, unknown or other
  misc_feature (256)..(256): n is a, c, g, or t
  modified_base (300)..(300): a, c, t, g, unknown or other
  misc_feature (300)..(300): n is a, c, g, or t
  modified_base (430)..(430): a, c, t, g, unknown or other
  misc_feature (430)..(430): n is a, c, g, or t
  modified_base (444)..(444): a, c, t, g, unknown or other
  misc_feature (444)..(444): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaggtgtcagtgtgaggtgcagcgtggtggagttcgtgggggaggcttcggtccaggccgtggggggtccctagagtcctctccgnggtgcacgtctcgtggacttccgtaccttcgtagtaattttagngtaccttagtggtcctaacggttcgggtcccgaccgtacggccgtacccggaaagggggtaacggaccgtaggtaatacgttcgtcgtaccgtaaggttagttaagaaacgttagcgtaagaaattaaanagttaatagtaganaactaatgtagaaggagataagtactacgacactacgtacgaagtaacaacgtacgaacgaactactacgtactattacgtaactaagtacggacgacgtacgtagaacgtacgtacgtagacgtacgaacgtacgtatacgttagttacggtaaggtaggaagtaacggtaaggaacgtaaggtacggttaagggtacgggtacggtacggtaccggaggg

SEQ ID NO: 268462 - DNA, 692 bp, Homo sapiens
  misc_feature: GYAE6OF02IQARB.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgtggggggtccctgagactctcctgtgcagcctctggattccaccttcagttatttatgctatgcacgtcggggtcccgccgagggcctacccggaagggggaacggggtacctaggggaaatagttcggtcctacgtaaggttaattaaggaagtaatggacgaaataaactattaattatttatgactaaacttcgtaggtaggaagggcaaggtactttaccgaaccctattccgtacccggaaggggtaaacctaacgtttaacccgaaaacgaaccccaaccggtacttacggttaacttaccttaacgaaagttccggggactaacggacccttaggaacgtagaccgtagggaacggacctacgggtcttaggtacttagttacggtgggttagggaggtaaggaggtacggtaagttcgggaaggttaggggttcgggtacggggaccgtaacgggg

SEQ ID NO: 268463 - DNA, 649 bp, Homo sapiens
  misc_feature: GYAE6OF02I7TG7.28.57.F02.1.454.CMB.1.raw
  modified_base (284)..(284): a, c, t, g, unknown or other
  misc_feature (284)..(284): n is a, c, g, or t
  modified_base (328)..(328): a, c, t, g, unknown or other
  misc_feature (328)..(328): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctcgtggattcaccttcagtatttangctatgcactcgggtccgcaggctccgagggaaggactggaatntgtctcgagtatagaagtaatgacgaataacataatacttagagactaaactctaggtaggaaggggcagtacttaccgaacattccgtacgaacgggaacctaaactttaccaaagaaccgtacgtacttagtactaccgttaacgaaagtcggggacaggtaccctaggacgtacgcgtagggtaacggaccgtacgggtacgttagttattaacgttacggtagggtaacgggtaagggaagggtaacggagggttaaacggttaggggtaaaccggtttagggggtttacgggtacgggggaccggttaacgggggg

SEQ ID NO: 268464 - DNA, 678 bp, Homo sapiens
  misc_feature: GYAE6OF02J1D2A.28.57.F02.1.454.CMB.1.raw
  modified_base (620)..(620): a, c, t, g, unknown or other
  misc_feature (620)..(620): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccaggccgtggggggtccctgagactcctcctgtgcagcctctggattccaccttcgagttatttatgctatcgcacgtggtccgccaggcctaccgaggaacgggctaggaattacgtggtactacgaggttaacttaaggaacgttaaagtcggacgtaaaacgtaactaagttaattaacttaagtacgaacttaaaaccgttcgttagtaacgggtaaacgggtccaaggtaactttacccgaacctaacgtttcccgtaccggaacgggaaccttaaccgttaaccgaaacggtaaccacggtacttacgttaacgttcctttaacgaagttccgggactaacgtccgtagacgtacgagtaggacggacacgggtcttacgttattagttacggngggttacggagtaggacggtaggagttacggacgttgggtagggtcggacgtacgggg

SEQ ID NO: 268465 - DNA, 648 bp, Homo sapiens
  misc_feature: GYAE6OF02HGPKV.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttgggtccaggccgtgggggggtcccctggagactctcctgtgcagcctctggattccacctttcagttatttatgctatgcacgtggggtcccgcccgaggtcctacccgaagggggaacgggtaccgtaggaaacttagtacggttctaccgaagggttaatttaacggaaaagttaatggaacggaaaattaaacattaattattaatagactaaactcgtagtaggaagggcagacttcgacatccacgaggactaactccaaagaaccgcgtactagtactacctagaagtggacagaccctgacgagtcgtagaacggaccgtcgggtattgtaattacgttagtgggtacggggagtaagggacggacgggttaagtttagggaaaccgggtttggggtaggtccgggggtaacgtaccggggg

SEQ ID NO: 268466 - DNA, 765 bp, Homo sapiens
  misc_feature: GYAE6OF02JZFSX.28.57.F02.1.454.CMB.1.raw
tcagagtacgctatcacgaccggtgctcgatttagctcgatatagttgggtctgggagaggagcccccgccctgggtttcccaggtgttgtcatttggtgatcagcactgcacacagaagagtcatgacggagtttgggctgagctgggttttccttgttgcttagttttaaaggtgtccagtgtgaggtgcagctggtggagtcgtgggggagcgttggtccagccgtgggggtcctggagactcgtcctgtcgcaggtcctcgtggtattacctacccgtttctaagttatttagtgtccttagtgtactacgtcgggtccgccgaaggtccaccggtaagggaacgggtaccgtggtaaaagtagttacgtcgttacgtaagggttaacgttaaaggtaagttaaagtacggtaacggtaaattaaagtaatttaataagttaagttacgaaactaaaccgttgtacggtaaggtaacgggtacgtaacggtaaacttaccgaaccgtacttaacccgtaaccgaacgggtaactaaacgttaccaaagtaaccacgtacgttacgtatacgtactaaacggtcggacgacgtaccgtaggtacgtaccgttacggacggtaacggtaaccggtacccggagttaaccgttagtaaccgtttacgggtcgggttacgggaagggtaacgggtacggaacggttaaggttaacgggttaacggttacggggtttacgggtaacggggtaccggtaaccggggg

SEQ ID NO: 268467 - DNA, 709 bp, Homo sapiens
  misc_feature: GYAE6OF02GH48C.28.57.F02.1.454.CMB.1.raw
  modified_base (290)..(290): a, c, t, g, unknown or other
  misc_feature (290)..(290): n is a, c, g, or t
  modified_base (700)..(700): a, c, t, g, unknown or other
  misc_feature (700)..(700): n is a, c, g, or t
  modified_base (706)..(706): a, c, t, g, unknown or other
  misc_feature (706)..(706): n is a, c, g, or t
  modified_base (709)..(709): a, c, t, g, unknown or other
  misc_feature (709)..(709): n is a, c, g, or t
tcagagtacgctatcacgaccggtgctcgatttagctcgatatagttgggtttgggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctagtatcttacaaagtggcagcctgagagcgtggaggacacggtntgttatattacgtggtgggagaggaggacggtaaagttacgggaacggttaggggttcgggtagggggccggaaggggtacgtccccgtgggttacccgacccggttacctcccgttacgaccggtcccctacccgaaacccggaaaccggggtcccctaacggtcccggtttccctttccccccgtcgggtccccgtccccgtcgtcctacccggaacggaccggtaccctacccggttaccggaacggtaccgaccgtaaccggacggcccgggtacccggtcgggtccgtcggtaccggttcggtaccgtaaccttaccgttacctaaggttaccgtaccgttacctccgtggtaaccgggtcgggtaccgtcgggaacccgaacgggccggtacgtaacggtacgngtacgncgn

SEQ ID NO: 268468 - DNA, 747 bp, Homo sapiens
  misc_feature: GYAE6OF02IMYL7.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtcgtggggggaggcttgggtccaggccgtggggggtccctgagacctctcctgtgcagcctctggattccaccttcagttattttatgtctatgcctacgtcggggtcccgcccgaggtccgtaccggaaggggaacggggtactagggtaacgtagtggtcctacgaggttaattaaggtaaagtaatagacgtaaataacattaattaattaatcgaactaaacttcgtaggtaggaacgggtctagtacttaccaacctatacccgtaccgaagggtaacctaacgttaaccctaaacgaaccgtaccggtcttacgttaacttaccgtttaacaaacggttcggggactacgggtaccgtaggaacggtacgtacggtaacgggacgggtaaccgtacgggtaccgtttaggttaacgtttaaccgtttagggttaggggtacggggtaaagggtaacggggtagggtaaccggggtaacgttttacggggtaaacgggttacgggggttttacggggtacgggggtacccggtaacggggg

SEQ ID NO: 268469 - DNA, 600 bp, Homo sapiens
  misc_feature: GYAE6OF02IM4LV.28.57.F02.1.454.CMB.1.raw
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (448)..(448): a, c, t, g, unknown or other
  misc_feature (448)..(448): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcttggccagccgtggggggtccccgagactctcctgtgcacgcctctggattcaccttcagttatttatgctatgcacgtgggtcccgccaggcctccgagggaacgggctaggaatatgtctcagttatagaagtanganaataacatatatatgactaaactntgtaggaggcagattcacctatccacgaggactaacttaccaaagaaccacgtcttagtattacttanaaacgtcgggacacgcctaggagacgtcgtaggacggtaccgacggtacttgaatttacgttagttcgggagggaacgaggggtacgtaacgggtaagtttacgggaaacggtttgggggttacgggtacgggggtaccgaggggtacccgg

SEQ ID NO: 268470 - DNA, 664 bp, Homo sapiens
  misc_feature: GYAE6OF02F9X93.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattcaccttcagttatttatgctatgcacgtgggtcccgccgaggcctaccgaggggaagggctaggaatagtcgtctcgtaaggtattaagaaagtatacggacgtaaattaaacattaattaattagtcgaacgtaaacttcgttaggtaaggacgggtacaggtacttaccaacctacttcccgtaacccggaagggtaaccttaaacgttacccgaaaagtaacccgaaccggttcttaagttacttaccgttaagtaaacggttcgggacctaggacccgttgaacgtacgtcgtaggaacgaccgtacggtcttagtattacgttagtcgggtagggaggtagggacgtaggtaagttacggtaaggttggggttacggcggggacgtacgggg

SEQ ID NO: 268471 - DNA, 584 bp, Homo sapiens
  misc_feature: GYAE6OF02IG1FB.28.57.F02.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtgggttttccttgttgctatttttaaaggtgtcagtgtgaggtgcagctggtggagtcgtgggggagcttggtccagcgtgggggtccctgagactctcctgtgcagcctctggattccaccttcagttatttangctatgcacgtcgggtcccnccgaggcctccggaaggggaaggtactaggaatagtgtactactaggtaattagaagtatgacgaataanatatattatagactaaatctagngaagggcagtataccaactatccaccgaggaactaacttcaaagaacacncttagtacttactacaaagtcggacacgacctaggacgagtcgtagaacggacgacggtcgttagtattaagttcgtagggtagggagtaggaacgtagggtaattagggtaacgttagggtggtcggggactacgggg

SEQ ID NO: 268472 - DNA, 716 bp, Homo sapiens
  misc_feature: GYAE6OF02I7YS8.28.57.F02.1.454.CMB.1.raw
  modified_base (198)..(198): a, c, t, g, unknown or other
  misc_feature (198)..(198): n is a, c, g, or t
  modified_base (312)..(312): a, c, t, g, unknown or other
  misc_feature (312)..(312): n is a, c, g, or t
  modified_base (369)..(369): a, c, t, g, unknown or other
  misc_feature (369)..(369): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtcgggggggancgtggtggaggttcgtggggggaggcgttggtccagccgtggggggtccctgagactctcctgtgcagcctctggattcaccttcagttattatgctatgactactgggtcccncgaggcctccgagggaacgggactaggaatatgtctacaggtagttagaagtacgtnacgaaatacatatatatagaactaaactcgttacgtaggaacgggtatacggtacttacccgaacctacgtaccgtaacggacggtaaactaaacttacccgaaagtaaaccgcgtacgttagttaaccttacttaaaccgtaagtaccggggtacaacggtcccgttaaggacgtaacggtcgagggaaccggaactagggtacccttaagtacgtttaacggttaccggtttaggggaacggttaaggggaaaccgggtaaggtacccggggttaaaggtttacggggtaaaacgggtttccgggggtttaacgggggttccgggggaaccggtaaccggggggg

SEQ ID NO: 268473 - DNA, 591 bp, Homo sapiens
  misc_feature: GYAE6OF02HZWR0.28.57.F02.1.454.CMB.1.raw
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcaactgcacacagaagagtcatgacggagtttgggctgtagctgggttttccttgttgcgtatttttaaaggtgtaccagtgtgaggtgcagctggtggagtctgggggagcttggttccagcctggggggtccctgagactctcctgtgcgagcctctgggacttccacctttcagttatttatgctatgcacgtgggtcccnccaggcctccgaaggggaaggactggaatatcgtctcaggtattagaagtaatgacgaataacatatattangacaaactctagtagaagggcagtattcacatcncgaggacaattccaagaacacgctagtatcttacaaagtcgggacagcctagagtacgctagacggtacgacggntacgtattaacttacgtggtacgggaaggagggtaacggtacgggtaagtttacgggaaaccgtttagggggtttacggttacgggggaccgtaacggggg

SEQ ID NO: 268474 - DNA, 719 bp, Homo sapiens
  misc_feature: GYAE6OF02G9AGQ.28.57.F02.1.454.CMB.1.raw
  modified_base (599)..(599): a, c, t, g, unknown or other
  misc_feature (599)..(599): n is a, c, g, or t
  modified_base (615)..(615): a, c, t, g, unknown or other
  misc_feature (615)..(615): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggaggcgttggtccagccggtcgggggggtccccgagacctcgtccgtgtcgcagcctcgtaggacttacctaccgtttcgtacgttatttagtcgtacgttatgctacgtcgggtacccgcgcggccgtaccggaaggggaacggtaccgtagggaactagtcgtctacgtaaggttaataaggtaagtaagtcggtaacgtaactaaagtaataattagtttaatacgaactaaacgtacgtagtaacggaacggactagtactttaccgaactacgtccgttaccggaaacgggtacttaaaccttaccgaaaacggaacctacgtaacgttacgttaacgtttaacctaacgtaacggttaggccgaacttcgacggtaaggtaccgngtaacgggagtaaccnggttcctaagtacttacgttaggtgggaagggtaggacggtacggaacgtttaacggtaggtaaccgggttaggttcgggggtacggccggtaagggtcccggg

SEQ ID NO: 268475 - DNA, 760 bp, Homo sapiens
  misc_feature: GYAE6OF02GKDRQ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaggtgtccagtgtgaggtgcagctggtggagtcgtgggggaggtcgttggtccaggccggtgggggggtccctggagacctctcctgtgcacgcctcgtggattcaccttcagttatttatgtctatcgcacgtgggtcccgcgacggcctaccggaaggggtaacgggacgtagggaaattacgtcgttcttacgtaaggttaagttaaggtaaagttaaggtcgaacggtaaaattaaacgtaattaaatttacgtttaagtacggtaaacctaaaaccttacgttaggtaagggtaaacggggacgtaaggtactttaccccgaactaacttccgtaacccggtacgggaaacctaacgttaacccgaaagtaccaacggttcttaacgttactaactttacgtaacggtcgggactaaccgggactaggaaggacgtcgtaacgggaacgtaccggaacgtcgttaagttaccgtttaagttaccgggtggggtaagggaacgggtagggtaacggtaacgggtttaaaggtacgggtttaaacgggttaggggttaccggggtacggggaccgggtaaccgggg

SEQ ID NO: 268476 - DNA, 775 bp, Homo sapiens
  misc_feature: GYAE6OF02IV0RY.28.57.F02.1.454.CMB.1.raw
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
  modified_base (383)..(383): a, c, t, g, unknown or other
  misc_feature (383)..(383): n is a, c, g, or t
  modified_base (690)..(690): a, c, t, g, unknown or other
  misc_feature (690)..(690): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttagtttttaaggtntccagtgtgtaggtgcagctggtggagtcgtgggggagcgttcggtccngccgttgggggtccctggagactcctcgtgtgcngcctctggattcaccttctagtatttangtctattcgcnccgtgggtcccacgcgcgtccgaggggtacggagtcggtaaatcgtcgtaccgtacgtaagggttaacttaaggaaggttaanacggtaacgtaaaagttaacgattaaattacgttaatacggaaccttaaacggttctacggttaaggaacgggtactacggttaacctaccgaaaccgtacgtttccgaaaccggtaaaggtaaccttaaacggttacccaaaacgggttaaccaccggttaaacgtttacgttaaacccgttacgtttaaacctaaaacggggtccggtaacctaaccggggtcttaaacgggataaccgggtttaacgcggttaaaccgggtaaaccggtccggttaaactagggttaacttacggtttaccggngggtttaacggggataaacgggaccggttaggttaacggtttaggtaaaccgggttggtttacgggtacggacccgttaaggggg

SEQ ID NO: 268477 - DNA, 681 bp, Homo sapiens
  misc_feature: GYAE6OF02FNVV4.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttgggtccagccgttggggggtccctgagactctcctgtgcagcctctggtattccaccttcagtttatttatgcttatgcaccgtggggtcccgaccgacgggcctcccggagggggaacgggacgtaggaattagtgttctcgaggttaattaagaaagttaagtcgagaaataacattaatattatagactaactcgttagtaggaagggcagtattaccaaccagttaccctaccgaagggaacctaaacgttcccaaaacgaaccgtaccgtacgtacgtttactacttaaccaaaggttcgggacacgaccgttagacgtacggtcgtaggaaccgacgtacgggtacttaggttacgttaagttaccggttgggtacgggtaaggtacgggtacggtacgggttaagtttcggggtaaacggttttggggtacgggtttcggggaccggttaacggggg

SEQ ID NO: 268478 - DNA, 744 bp, Homo sapiens
  misc_feature: GYAE6OF02IGBRD.28.57.F02.1.454.CMB.1.raw
  modified_base (255)..(255): a, c, t, g, unknown or other
  misc_feature (255)..(255): n is a, c, g, or t
  modified_base (282)..(282): a, c, t, g, unknown or other
  misc_feature (282)..(282): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcngcctctggattcaccttcagtatttangctatgctacgtcgggtcccgccgaggtcctacccggaagggggaaacggggaccttaggggaattaagttcggttctacgtaagggttaagttaagaaagttaaagtgaacggtaaaataaacgtaattaatttaactttaagtacggaactaaaacttcgttaggttaaggaaggggtctaaggtactttaccgaaacccgtacttacccggtacccaaaggggtaacctaaacgtttaacccgaaaacgtaaccgtaacgtaccgttaggttaactttaccgtttaacaaaacggtcgggaacgtaccggtccgtaaggacgtagccgtaaggacggaacggtcggtacgtttacgtattaacgtttcggtaagggtaggggaggtaacgggaggtaaccggtaaggtttacggggtaaaggtttacgggggttagggtacgggggacctaacgggggg

SEQ ID NO: 268479 - DNA, 621 bp, Homo sapiens
  misc_feature: GYAE6OF02I1IZC.28.57.F02.1.454.CMB.1.raw
  modified_base (273)..(273): a, c, t, g, unknown or other
  misc_feature (273)..(273): n is a, c, g, or t
  modified_base (343)..(343): a, c, t, g, unknown or other
  misc_feature (343)..(343): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
  modified_base (568)..(568): a, c, t, g, unknown or other
  misc_feature (568)..(568): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcggtgtttcgtgtaggctatttaagtgtccagtgtgagtgacagctggtgagtcgtgggggagtcgttggccagtccgtggggggtccctggacgacttctccttggtgcacgccttcgaggtattccncctttcgagttattctgactatgacagtcggtcccgacgcggctccgaggggaacggtcgtaggtaaatntgtcctagtaggtaactagtagtaatcgagaaatacgattatacgttancgaactaacgtctgttagaacgggtnacgtatctacattccgacgaggtacctaataccgaaacggactaccggtattagtacttacgttaacgaacgaagggtccgaacgtccgttaggaaccgtggtacgttacgaaacgggccgtaacgtcggtaataccgtatttaaccggnggtaggacggtacgggagagtcgttaggtacggtgggtaggtcgggccgaggg

SEQ ID NO: 268480 - DNA, 630 bp, Homo sapiens
  misc_feature: GYAE6OF02F5D1O.28.57.F02.1.454.CMB.1.raw
  modified_base (331)..(331): a, c, t, g, unknown or other
  misc_feature (331)..(331): n is a, c, g, or t
  modified_base (393)..(393): a, c, t, g, unknown or other
  misc_feature (393)..(393): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttggggctgagctgggttttccttgttgctatttttaaaggtgtccagtgtgaggtgcagctggtggagtctgggggaggcttgggtccagccgtgggggggtccctgagactctcctgtgcagcctctggattcaccttcagtatttatgctatgcactgggtccgccaggctccgaggggaagggactggaatntgtctcgtagtattaagaagtatgacgaataacatatattatgactaaatctgtagaagggnagattcactatctacagggacaacttaccaagaacacgactgtactaccttactaaagtcggggacacgaccgtaggagacggcgttaggaacggaccgaaccgggtcttaggtactttagttaaccggttgggtaggggtaagggtaaggggtaacggaaccggggttaaggtttacgggtaaaccggggtttagggggtttacgggggttacgggggtacccgggtaacgggggg

SEQ ID NO: 268481 - DNA, 569 bp, Homo sapiens
  misc_feature: GYAE6OF02IFE0U.28.57.F02.1.454.CMB.1.raw
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagttatttatgctatgcacgtgggtcccgaccgtagggcctccgaggggaacgggacctaggggaatntgtccgtcgtaggttattaaggtaagtagtgacgaaataacattaatattatcgataactntggtagaggcagatacaccatctcgaggtactactacaagacacntcgtatccgtanaagtggactagcgttagacgagtcgagaacgacgacgtntagtatcgttacgnggtaggagtaggaggtaggtaagttggaacggttgggtgggtacgggacgtacgggg

SEQ ID NO: 268482 - DNA, 711 bp, Homo sapiens
  misc_feature: GYAE6OF02JU8MQ.28.57.F02.1.454.CMB.1.raw
  modified_base (334)..(334): a, c, t, g, unknown or other
  misc_feature (334)..(334): n is a, c, g, or t
  modified_base (372)..(372): a, c, t, g, unknown or other
  misc_feature (372)..(372): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcttgggtccagccgtggggggtccctgacgactctccgtgtgcagcctcgtggattcaccttcagtatttatgactatgcacgttggtcccgcaggcctccgagggaggactggaactntcgtctcgaggttataacgaagttagtgacgaattaanattaagtattatgactaaacttgtaggtacggaagggacagtacttccgaaacctattacccgtacgaacgggaaacctaacgttaacccaagtaaacccaacggtctacgttaactttaccgtaactaaacggtcgggactaacggtaccgttagggaaccggagtaccggttaacggaacggtaacccgtaacccgggtaagttacggtttattaaccggtttaacggttcggggtaagggtaagggaacggggtagggtaacccgggtttaagggttacgggttaaacgggtttagggggtttacggggttacggggggaacccggtaaccggggg

SEQ ID NO: 268483 - DNA, 753 bp, Homo sapiens
  misc_feature: GYAE6OF02HRTQA.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgttgggttttccttgttgtcttatttttaaaggtgtccagtgtgaggtgcagcgtggtggaggtcggtgggggaggtcgttggtccaggtcccggttggggggtcccctggacgtacctcttccgtgtcgcacgtccctcgtggtattcctacctttactaagttattttagtgtcttagtcgcctacggtcgggtcccgaccgacggtccgtaccggaaggggaacgggtacgtaggtaattacgttcgttactacgtaaggttaattaaggaaagttaagtgaacgtaaataactaataagttaattagtacgtaactaaacttcgtaggtacggaagggactaagtactaccaccgtaactcccgtaacgacggtaactaacgttaaccgaaacgtaacgaccggtactttacgttaacttaccttaagtaaacggtcggtaccgaacggtaccgtaggaacgacgtacgtacggaacgggaccgtacggtcgttaagttacgtttaagttaccggtagggttaacggggaggaagggtacggtaacgggttaagttacggggtaacggtttaagggggttcggaacgggggcgtaaccggggg

SEQ ID NO: 268484 - DNA, 685 bp, Homo sapiens
  misc_feature: GYAE6OF02G4891.28.57.F02.1.454.CMB.1.raw
  modified_base (312)..(312): a, c, t, g, unknown or other
  misc_feature (312)..(312): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcgttggtccagcccgtggggggtccctgacgctctcctgtgcagcctcgtggtacttcaccttcagttatttatgtctatgctacgtcggggtcccnccgaggccgtacccggaaggggaaggaccgtagggtaattagtcgtctacgtaggttaattaaggaaagtaagtgaacgtaataaactattaattacttagtacgactaaacttcgtaggtaggaagggtacagtacttaccgacctaacttccgtaccgtaacgggaacctaacgttaacccgaaagaaccctacgtacgtagttaacttccttaacgtaaagtccgggtanaccggtccgtaggacgtaggaccgttaggaccgggacacggtacgttagtacttacgttagtcgggttagggaaggtagggagtaacgggttacggtttagggaacggtttagggggtcggtacgggggacgtacggggg

SEQ ID NO: 268485 - DNA, 724 bp, Homo sapiens
  misc_feature: GYAE6OF02IMG0S.28.57.F02.1.454.CMB.1.raw
  modified_base (292)..(292): a, c, t, g, unknown or other
  misc_feature (292)..(292): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggagcgttggtccagccgtggggggtccctggacgactctcctgtgcagcctcgtgacttccaccttcaagttattttancgtctatcgcctacgtcgggtcccgccgaggcctaccggaaggggaacgggtactagggaatagtcgtactacgtaaggttattaaggaaagtaagtcgaacgtaaataaactattaattaattaatacgaacctaaactcgttaggtaggaaacgggtctaaaggtacttaccgaaaccctacgttacccgtacccggaaggtaaacctaaacttaaccgaaagtaaacccgtaaccgtacttaagttaaccttacctttaacgaaacggttcgggaaccacggtaccgtaggaacgacggtacgacggaccggaaccgtacggtcgttaacgtacttacgttacggtggtacgggtaaggacgggtaaggacgggttaaggttacgggtaacgggtttaggggtacgggtacggggaccggtaacggggg

SEQ ID NO: 268486 - DNA, 593 bp, Homo sapiens
  misc_feature: GYAE6OF02GLJ8N.28.57.F02.1.454.CMB.1.raw
  modified_base (331)..(331): a, c, t, g, unknown or other
  misc_feature (331)..(331): n is a, c, g, or t
  modified_base (377)..(377): a, c, t, g, unknown or other
  misc_feature (377)..(377): n is a, c, g, or t
  modified_base (466)..(466): a, c, t, g, unknown or other
  misc_feature (466)..(466): n is a, c, g, or t
  modified_base (484)..(484): a, c, t, g, unknown or other
  misc_feature (484)..(484): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattccaccttcagttatttatgctatgcacgtgggtcccgcgaggcctccgaggggaaggctaggaatntgtctacgaggttattagaagtaatgacgtaataacattatattangactaactcgtagtaggaagggcagtacttaccactatccaccgaagggactaacttaccaaagaaccacgtactagttacttcctaanaagtgggacagctggagngcgtaggaacggacgacggtcttagtacttagttacggtggtaaggggagaaggaggtacggtaagttacgggtaacgttagggggttcggtacggggacgtaacgggg

SEQ ID NO: 268487 - DNA, 747 bp, Homo sapiens
  misc_feature: GYAE6OF02HU5N6.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtcagtgtgaggtgcagctggtggagtcgtgggggaggcttgggtccaggccgtcgggggggtccctggagtactctcctggtgcagcctcgtggtattccacctttcgagttattttagtcgtacttagtgctacgttcggggtacccgcccgaggccgttacccggaagggggaacgggctagggaaattagttgtctacgtaggttaattaaggaaagtaatgacgtaaataacgaattataacttatacgactaaaacttcgtaggaggaagggtactaggtacttacccgaactacgttacctaccggaagggtaacctaacgttaacccgaaacgtaaacgtaccgtacgttacgttaaccttaccgttaaacgaaacggtcgggtaaccaaccggttaccgttaggaaacggtgaccgttagggaaccgggtacaaccgggtacttagttaacgttacgttaacgggtgggtaacggggtaaggaacggttaaacgggtcggttaaacggttacggggtaaaccggtttgggggttaacgggtcgggggtaacccgtaacggggg

SEQ ID NO: 268488 - DNA, 766 bp, Homo sapiens
  misc_feature: GYAE6OF02I0324.28.57.F02.1.454.CMB.1.raw
  modified_base (253)..(253): a, c, t, g, unknown or other
  misc_feature (253)..(253): n is a, c, g, or t
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
tcagagtacgctatcacgaccggtgctcgatttagctcgatatagttgggtcgtgggagaggagcccccgccctgggttcccaggtgttctcattggtgatcagcactgcacactagaagtagtcatgacgggagtttgggctgagcgtgggtttccttgttgctattttaaaggtgtccagtgtgaggtgcagtctggtggagtcgtgggggagctggtcagccgtgggggtccctagagacctctcctgtntcagcctcgtgattaccacgttcagttacgttatcgactatgacgtaacgtgggtacccncgacgcgtaccggaagggaggacctaggtaacttcgngtacgtacgtaacggttacgtaaggtaacgttacacgacgtaaacgtaagtagttaaagtattaaggtacggtactaaaacgttacgtaggtaacggtaacgggtacctaacggttacgtacccgtaaactacgttcctaacccgggtaagggtaaaccttaaacggttaacccgaaacgaaacccgtaccgttacgttaaacgttacttaccccgttaaaagttaaacggtcgggtaactaaccgttaacccggtagtaacggtacccgaggttaacgggaaaccgaacccgggtacgtaaccgttgttaaacccgttaggttaaccggtagggtaaccggggtaacgaagggtaaccgtaaggtaacgtttacgggaaacgggttagggtccgggttacgggaccgtaacgggg

SEQ ID NO: 268489 - DNA, 657 bp, Homo sapiens
  misc_feature: GYAE6OF02JZZDK.28.57.F02.1.454.CMB.1.raw
  modified_base (293)..(293): a, c, t, g, unknown or other
  misc_feature (293)..(293): n is a, c, g, or t
  modified_base (525)..(525): a, c, t, g, unknown or other
  misc_feature (525)..(525): n is a, c, g, or t
  modified_base (567)..(567): a, c, t, g, unknown or other
  misc_feature (567)..(567): n is a, c, g, or t
  modified_base (640)..(640): a, c, t, g, unknown or other
  misc_feature (640)..(640): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtcagtccgtggggggtccctggagactctccgtgtgcagcctcgtggattcaccttcagtatttatgacttagtnaccgaggtcggtccgtacccgagggtcctaccggaagggaacgggtactggtaatacgtgtacgtaccggaagggtttaactaaggaaaggttaactggtaaccgtaaattaaacctattaacttagtttaacaggtaacctaaaacttccgttaggtaaggaacgggtactagtaaccttcgaaccttacttcgacgtaaacggacttaaaccgtacaaacgacgacgttntaacgttactcttaaacaggtacggtcaacgtccgagtaagnttacgaggacgtcggacgtactagtacttagtactggggtagcggaagtcggaataggtacgaggtttagggnggtaccggaggtaaggg

SEQ ID NO: 268490 - DNA, 756 bp, Homo sapiens
  misc_feature: GYAE6OF02ICKBM.28.57.F02.1.454.CMB.1.raw
  modified_base (315)..(315): a, c, t, g, unknown or other
  misc_feature (315)..(315): n is a, c, g, or t
tcagagtacgctatcacgaccggtgctcgatttagctcgatatagttgggtctgggagaggagccccccgccctgggtttccccaggtgttctcatttggtgatcagcactgcacacagaagagtcatgacgggagttttgggctgagcttggggttttccttgttgcttatttttaaaggtgtccagtgtgaggtgcagctggtggagtcgtgggggaggtcgttggtccagccgtggggggtccctgagactctccgtgtgcagcctctggattccaccttcagttatttatgtctatgctacgtcgggtccncccgaggcctaccggaggggaaggtactaggaatagtcgtacgtacgtaaggttaattaaggaaagttaagtacggtaacggtaaaattaaaacgtaattaagttaatttaagtacgtaacctaaaaccttcgtagggttaaacggaacggggtaacctaagtttaactttacccgaaccttaacgtccccgtaaaccggaacgggtaaacctaaacgttaacccgaaaagaaacccgtacgtacgttacgttaacgttaccgtttaacgtaaaggtccgggtactacggtaccgttagaaacggtagaccgttaggaaccggtacgacgggtctacgttaattacgtttagggtacgggtaggaagggtacggtaagggtacggttaaggttacgggtaacgggttagggtttacgggtacgggggaccgttaacggggg

SEQ ID NO: 268491 - DNA, 829 bp, Homo sapiens
  misc_feature: GYAE6OF02IWA4U.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctattttaaaggtgtccagtgtgaggtgcagctggtggagtcgtgggggaggcttggtccaggccgtggggggtcccctggagactctcctgtgcagcctctggattccaccttcagttatttatgtcttagtgctacgtcggggtcccgccgacggccttcccggaaggggaacggggtaccgtagggtaattagtcgtcgtacgtaacggttagttaaggtaaagtaagttcgaacggtaaaataactaatttaaattattaagtgtaactaaaacttcgtaggtaggtaaacgggctaagttaacttaccgaacctacgttaccgtaccgaacgggtaacttaaaccgttaccgaaaacggtaaacctaaacggtacccgtttaaggtttaaccttaaccgtttaacgtaaaaacgggttccgggtaaccgtaaccggtaccggttaacggaaacggtaccgggttaacgtacggggtaaacgggaaacccggaaccgggttacccgttttaagggtaacctttttaacggttaccggtttaacgggggttacgggggtaaagggtaacgggggtaacggttaacgggttaaacggtttaaccggggaaacgggttttacggggggtttaacgggggtaccgggggtaccggtaaacccggggggg

SEQ ID NO: 268492 - DNA, 741 bp, Homo sapiens
  misc_feature: GYAE6OF02HDLJG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctgggtggagtcgtgggggagcgttggtccaggccgtggggggtcccctggagacctctcctgtgcagcctcgtggtacttccgaccttcagttattttatgacttatcgctacgtcgggtcccgccaggcctaccggaggggaacgggacgtagggaattagttcgtcttacgtaaggttagttaaaggaaagttaatcggtaacgtaaaattaaacatttaaatttattaagtacgactaaaacgttctaggtacggaagggtacaagtacttaccgacctaacgtacctaccggaacggtaacctaacgttaacccgaaacgaaccgaccgtacgttacgttaacttaccttaagaacggtcgggacaacgtcccgtaggtaacgtacggtcgtacgggaaccggtacgaacggttacttacgttaacttacggtttaccgtaagggggtacggtaaaggggtacggtaacgggtaacggttaacggttacggggtaacggtttacgggggtttacggggtacgggggaacccggtacggggg

SEQ ID NO: 268493 - DNA, 820 bp, Homo sapiens
  misc_feature: GYAE6OF02HSVKM.28.57.F02.1.454.CMB.1.raw
  modified_base (301)..(301): a, c, t, g, unknown or other
  misc_feature (301)..(301): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
tcagagtacgctatcacgaccggtgctcgatttagctcgatatagttgggtctgggagaggagcccccgccctgggtttcccaggtgttctcatttggtgatcagcactgcacacagaaagagtcatgacgggagtttgggctgagcgttgggttttccttgttgcttatttttaaaggtgtccagtgtgaggtgcagcgtggtggagtcggtgggggagtcgttggtccgaggtccggtcggggggtccctggacgactctccgtgtcgacacgcctcgtggtacttccacttcaagttntttangtacttangtcctacggtcgggtcccgccgagggccgttaccggaaagggggtaagggtacgttacgggtaaacttacggttcgtaccgttaccggttaagggttaaacgtttaaaggtaaaggttaaacgtacggtaaccggtaaaacttaaacgtaattaagtttaaacttatacggaaacctaaaacgttcgtagggttaaggaacgggtactaacgtaacgttaccgtaacccgtacgttaacccgtaccggtaaacggtaacgtaaaccgttaaccgaaacgtaaccgtaccgtacgtttacgtaccgtttaccgttaaacgtaacggtaccggaccgtaacgtaccggtacgtaacgacgtaccgtaaggaacggaccgtaaccggtagttaacgtaacgtttagtttaccgggtgggttaagggaacggtaggggtaacggtaaccggttaggttaacggggttaacgggttacggggttagggtaccgggggtacgtaaccggggg

SEQ ID NO: 268494 - DNA, 851 bp, Homo sapiens
  misc_feature: GYAE6OF02GZ0QL.28.57.F02.1.454.CMB.1.raw
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggctgagctggtttctgtgctattttaaggtgtccagtgtgaggtgcagcgtggtggagtcgtgggggaggtcgttggtcccgacggccggttcgggggggttcccctggacgtaccgtccgttccgtgtcgcgtacgcccgtcgtggtacttcaccgtttcgtaagttattttancggtctagtgcctacgtcggggtcccgaccgacggtcctaccggaggggaacgggtacgtaggaaattacgttgtccgttacgagggttaacgttaaggaaagtttaacgtacggaaccggtaaattaaaccgtattaaacgtttaaagttagttacggaaccttaaaacgttccgttaaggtacgggaacgggtacgtaacgtaacgtttaacccaccgtaacgttcccgttaacccgggaaacggggtaaaccttaaaccgtttaaaccgaaaaccggtaaacccgtaaccggttacgttaacgtttaactttacccgttaaaccgtaaacggtttcgggaacccgtacgggttacccgttagggaacgtaaccggtaacgttaacggggaaccgggttaaccggaaccgggtactttaacgggttatttaacggttacgggttggtaaggggggaacgtaggggaacggtaacggggttaagttaccggggtaaacggtttagggggttcgggttaccggggacgggtaaccgggg

SEQ ID NO: 268495 - DNA, 540 bp, Homo sapiens
  misc_feature: GYAE6OF02G5QER.28.57.F02.1.454.CMB.1.raw
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (451)..(451): a, c, t, g, unknown or other
  misc_feature (451)..(451): n is a, c, g, or t
  modified_base (459)..(459): a, c, t, g, unknown or other
  misc_feature (459)..(459): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttggggctgagctggggttttccttgttgctatttttaaaggtgtccagtgtgaggtgcagctggtggagtctgggggaggcttggtccagccgtggggggtccctgagactctcctgtgcagcctctggattcaccttcagttatttatgctatgcacgtgggtccgccaggcctccgaggggaagggctagggaatatgtctcgaggttatagaagtaangacgaataacatatattangacaactntgtgaggcagntcacatcncagganactcaacacacgntgtactctacaagtggacacgctgagacgngagaggancggactgtatattagtgggtagggaagagggtaggacggttaagtagggtaacgtaggggttggtacggggacgtacgggg

SEQ ID NO: 268496 - DNA, 637 bp, Homo sapiens
  misc_feature: GYAE6OF02GVP8X.28.57.F02.1.454.CMB.1.raw
  modified_base (304)..(304): a, c, t, g, unknown or other
  misc_feature (304)..(304): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (393)..(393): a, c, t, g, unknown or other
  misc_feature (393)..(393): n is a, c, g, or t
  modified_base (400)..(400): a, c, t, g, unknown or other
  misc_feature (400)..(400): n is a, c, g, or t
  modified_base (451)..(451): a, c, t, g, unknown or other
  misc_feature (451)..(451): n is a, c, g, or t
  modified_base (475)..(475): a, c, t, g, unknown or other
  misc_feature (475)..(475): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtggggggtccctgagactctccgtgtgcagcctctggattccacctttcagtatttatgctatgcactgggtcccncaggctccgagggaagggactggaatatgtctcgaggtatagaagtangcgaatacatatattangactaaatctgtagagggcaagtnttcaccntcctaccgagggtaacaacttaccaaagaaccacgactagttactacttanaagtagggcaagtacctggaacgngtacgttgaacgggaccacgggtccttaggtaactttaacggtttaacggttcggggtaaggggtagggtaaacgggtacgggtaagggttaaacggtttacggggtaaaccggtttaagggggggtttcgggttacggggggaacccgttaaccggggggg

SEQ ID NO: 268497 - DNA, 682 bp, Homo sapiens
  misc_feature: GYAE6OF02I6AZ3.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtcgtgggggaggcttggtccagccgtggggggtccctgagactctccgtgtgcacgcctcgtggtacttcacccttcagttatttatgtctatgcacgtcgggtccgcgaggcctccgaggggaacggacgtaggaatatgtctagtaggttataagaagtaatgacgtaaataactattatattatagtactaaacgtctaggtaggaacgggtactaggtacttaccaacctagttacccgtaccgaaagggtaactaacttaccgaaaagtaacccacggttctagttaactccgtttaacaaaggtccgggactacggtcccgtaggaaacgtcggtccgttaagggaacccgggacttaaccggggtactttagtaactttcgttaaggggttcggtaaggggaacgtagggtaccgggaacggttagttacggggtaacgtagggggtttcggggtacggggcccgtaacggggg

SEQ ID NO: 268498 - DNA, 688 bp, Homo sapiens
  misc_feature: GYAE6OF02H8ZM3.28.57.F02.1.454.CMB.1.raw
  modified_base (666)..(666): a, c, t, g, unknown or other
  misc_feature (666)..(666): n is a, c, g, or t
  modified_base (682)..(682): a, c, t, g, unknown or other
  misc_feature (682)..(682): n is a, c, g, or t
  modified_base (685)..(685): a, c, t, g, unknown or other
  misc_feature (685)..(685): n is a, c, g, or t
tcagagtacgctatcacgaccggtgctcgatttagctcgatatagttgggtttggggggtccctgagactctcctgtgcagcctctggatttcaccttcagtatttatgctatgcactgggtccgccaggctccagggaagggactggaatatgtctcaggtattagaagtaatgcgaataacatatattatgacaaactctgtaggaagggcagattcaccatcctccgaggacaattccaagaacacgctgtactcttacaaatgggcagcctgagagctggaggacacggcgtgtattaattacgtggtagggagagggagacgggtaagttagggaacgttaggggtttggtggggccggaagggtacgcccgtggtccgaccgtctccgtcgacgtccctccgaccgaacggcccacgtcggttcccttcccccgtggccgtccccgtgcccctaccgacggacgacccgtacccgtaccggacgtacggaccgaaccgtacggcccgggtaccccgtgggggaccttccggacccgttacgggtaaccggaaacgggtaacccctttaaccgttacccgtaaacgtccgggtaaccgttaccgttaccggttagggaacggtacccgggggtccgtacgggtacccggtaacggggaccncggtaaacggtaccgngangac

SEQ ID NO: 268499 - DNA, 889 bp, Homo sapiens
  misc_feature: GYAE6OF02IO0TO.28.57.F02.1.454.CMB.1.raw
  modified_base (320)..(320): a, c, t, g, unknown or other
  misc_feature (320)..(320): n is a, c, g, or t
tcagagtacgctatcacgaccggtgctcgatttagctcgatatagttgggtctgggagaggagcccccgccctgggtttcccaggtcgttctcatttggtgatcagcactgcacacagaagagtcagtgacggagtttgggctggagcgttgggttttccttggttgtctttaagttttttaaaggtgtcctagtggttggaggtgcagcgtgggtggagtcggtggggggaggtcgttggtccaggccggtgggggggtcccctggacgtacctctcctggtcgcacgcctcgtggtacttccacttctagttatttangtctatgctacggttcgggtcccgcgacggcctaccggaagggggaacggtacgtaaggtaattacgttcggtacttacggtaaaggttaacgttaaggtaaagttaagtcggaaaccgtaaaagttaaacaatttaagtttaagtttagttaaccgaacttaaaaccgttcgttaaggggtaacgggtaacggggtaaccgttaagttaaccgtttaccaaacccgttaacgtaccccggtaaaccggggtaaaacgggtaaccttaaaacgttaaccccggaaaaacgtaaacccgtaaccggtttacgtttaaccgttaacctttaacgttttaaaccggaaaacgggttccgggaaaccgtacgggttaccgttaagggaacggaacggtacggtaacgggtacgggaaacccgttacgtacgtttacgtaaacgtttttacgttacggggtgggttaaagggggtaacgtacggggtaagggttaacggttaaccggggttttaaagggttaacccggggttaagggggtttacgggtaccgggggggtacccgtaacgggggg

SEQ ID NO: 268500 - DNA, 696 bp, Homo sapiens
  misc_feature: GYAE6OF02FY4GT.28.57.F02.1.454.CMB.1.raw
  modified_base (490)..(490): a, c, t, g, unknown or other
  misc_feature (490)..(490): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcaatgacggagtttgggctgagcgtgggttttccttgttgcttagtttttaaaggtgtccagtgtgaggtgcagctggtggagtcgtgggggaggcgttggtccagccgtcggggggtccctggagactctcctgtgcagcctctggattcaccttcagttatttatgtcctatcgctacgtgggtccgccgacggcctccggaggggaagggctaggaacttgtgtctacgtagttacgttaagaaagtaatcgacgtaaataactataattattagtgaactaaactcgttaggtaggaacggtacaagtaacttccgaacctactccgtaaccgaaggtaaactaacgttaacccaaagaaccncgtcgtagttacttccttaacgaagtcgggacaacggtcgtacggaagacggacgttcggtaaacggaccgtaccgggttactagtttacgttacgttacggttcggggaaagggtacggtaacgggtaacgggtaacggtttaaggttacgggggtaaacggtttaggggggtttcgggggtaccggggcccgggtaacgggggg

SEQ ID NO: 268501 - DNA, 816 bp, Homo sapiens
  misc_feature: GYAE6OF02H0JAX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctcgtggtacttccacctttcagttattttatgtctagtgctacgttcggggtcccgccgacggcctaccggaagggggaacggggtaccgttagggaaacttagttcgttaccgttacgtagggttaattaagggtaaaagttaaagttcggtaacgtaaaaacttaaaactaagtttaaactttaaagtttaaagttacggtaaccctaaaaaccgtttccgttaagggttaacggggaaacggggtacctaaaggtacttttacccaaaccctacgttaccccgtaccgggtaaacgggtaacctaaaacgttaacccgaaaacggtaaaccctaaccggttacgtttacgtaactttacccgtttaaacaaacgggttcgggacaaccggtacccggtaggaccgtacggtacgtagggaaccggtaaacggtaccgggtacgtttagttaacgttaacgtttaccggtagggtacggggaaaggaacgggtacggaacgggttagttaacgggtaaccggtttagggggtcgggtaccggggacggtaaccgggg

SEQ ID NO: 268502 - DNA, 617 bp, Homo sapiens
  misc_feature: GYAE6OF02IALHO.28.57.F02.1.454.CMB.1.raw
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
tcagagtacgctatcacgaccggtgctcgatttagctcgatatagttgggtcgtgggagaggagcccccgccctcgggtttcccaggtgttctcatttggtgatcagcactgcacacagaagagtcatgacggagtttgggctgagctgggttttccttgttgctattttaaaggtgtccagtgtgaggtgcagtctggtggagtcgtgggggaggcttggccagccgtggggggtccctgagtactctcctgtagcagccctgtggatcctaccttcagttattatgctatgcactgggtcccgcgaggtctccgaaggggaagggacttaggaatagtgtctcgaaggtattaagaaagtactgacgaaataanaattatattaanagtaactaaatgtagaggaacgcatatacacactacaccgaggtaactaactacaagacagtactatacttactaacgaagaggtacacgacgtagaagtagacgtagaacgacgacgtgtaactagttacgttaacggtgggtaagggaggaacgggtaacggtaacggtaacggttaacgggttaacgggttaacggggtttcgggtaccgggggaccggtaacggg

SEQ ID NO: 268503 - DNA, 973 bp, Homo sapiens
  misc_feature: GYAE6OF02FW7AH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagcgtggtggagtcgtgggggagcttggtccagccgtgggggtccctgagactctccgtgtcgcacgcctcgtaggtacttccaccctttgacgttaacttttagtcggtacttagtcggtacctacggttccggggtacccgtaccgacggggtccccgttacccgggaaggggggtaaaccggggtaaccggttacggggtaaaactttacggttccggttaccgtttaaccggtaacggggttttaaacgtttaaaggtaaaacggttaaacggttcgggtaaacccggtaaaagttaaaccgtaacgtttaaagtttaacgtttaagttacggtaaacccttaaaacccgtttacggttacgggttaacggtaaacccggggtctaaacggttaccgtttaacccgtaaacccttaaccgtttacccgttaaccggaaaccggggtaacctttaaaccgtttaacccgaaaaccggttaaccgtaacccggttacgttaacgtttaccgtttaaccgtttaaaacgtaaaacggttccgggtaaccgtaaccggttacccgttaagggtaaccggtacggttaccggtaacgggtaaaccggtaacccgggtaacgggttacccgtttagttaaccgtttaacggtttaaccggggtttaacgggtagggggtaaacggtaacgggtaaaccgggttacgggttaaacgggtttaccggggttaaaccgggtttacggggggttacgggttaccgggggacccggttaaccgggggg

SEQ ID NO: 268504 - DNA, 762 bp, Homo sapiens
  misc_feature: GYAE6OF02GR3C8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaaggtgtccagtgtgaggtgcagctggtggagtcgtgggggaggcgttggtccagccgtggggggtccctgagactctcctgtgcgagcctcgtggattccaccttcagttatttatgctatgcctacgtcgggtcccacgacggtcctccgaaggggaacgggtactagggtaaatgttgtcctacgagggttaattaaggaaagttaagtacggaacgtaaaataaacgtaattaattaacgttatacggtaactaaaaccgttcgttaggtaaggtaaacgggtctaaggtaacttaccgaaccctagttacccgtacccggaacgggtaacctaaagttacccgaaaagtaacccgacggtacgttagttaacttaccgttaactaaaggttccggggacaacggtacccgttagggaacgtacggtaccgttaagggaaccggaacccggttaaacggggtcccgtttaagttaaccgtttaacgtttaccgggtacgggtaacggggtaaggtaacggggtaaggtacgggtaaggtttacgggtaaccggttaggggttacgggtacgggggaccggtaaccgggg

SEQ ID NO: 268505 - DNA, 711 bp, Homo sapiens
  misc_feature: GYAE6OF02I1NFT.28.57.F02.1.454.CMB.1.raw
  modified_base (631)..(631): a, c, t, g, unknown or other
  misc_feature (631)..(631): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaaggtgtccagtgtgaggtgcagctggtggagtcgtgggggaggcgttggtccagccgtggggggtccctgacgactctcctgtgcagcctcgtggacttcaccttcagttatttatgtctatcgctacgtcgggttccgccgaggctccggaaggggtacgggacgtaggaatagtgtccgtacgtaggttaacttaaggaaagttaatcggaacgtaaacgttaactaattaagtttaatttaagtacgtactaaacgttacgtaggttaggaacgggacgtaagtacgtttacccaacgttacttccccgtaccggaaacgggtaaccttaaacgttaacccgaaacggtaacccacggttactagttaacttccgttaacgaaggttcgggctaaccgggtactaggacgacgtcgtaggaacggtccgtaacggcttagtattaacgtttacggnggtacggggaagtaacgggtaggtaaccgggttagttaacgggtaaggttacggggtttggaccgggggtcggtaacggg

SEQ ID NO: 268506 - DNA, 554 bp, Homo sapiens
  misc_feature: GYAE6OF02I4R96.28.57.F02.1.454.CMB.1.raw
  modified_base (260)..(260): a, c, t, g, unknown or other
  misc_feature (260)..(260): n is a, c, g, or t
  modified_base (432)..(432): a, c, t, g, unknown or other
  misc_feature (432)..(432): n is a, c, g, or t
  modified_base (476)..(476): a, c, t, g, unknown or other
  misc_feature (476)..(476): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccaggcctggggggtccctgagactctcctgtgcagcctcnggattcaccttcagtatttatgctatgcacgtggtccgccgaggctccgagggaagggactggaatatgtctcaggtacttaagagtaatgacgaagtaacagtaatattatgacaaacttctaggtagaacgggcaagattccacatctcaggacaacttacaacaacacntgtatcttacaagtgggacacgcctgagagcgtgacggacacgnttagtatacttacgtggtagggagaggaggacggtaagttcgggaaacgttagggtcggttacgggacggtaacgggg

SEQ ID NO: 268507 - DNA, 698 bp, Homo sapiens
  misc_feature: GYAE6OF02GM7N1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtgggttttccttgttgctattttaaaggtgtccagtgtgaggtgcagctggtggagtcgtgggggagcttggtccagccgtggggggtccctgagactctcctgtgcagcctctggattccaccttcagttatttatgcttatgctacgtgggtcccaccgaggccttaccgaggggaagggactggaatagtgtctagaaggtataagtaagtaatgacgtaaataacgattaatattagcgaactaaacttctaggacggtaacgggacaacgtataccgaacctagtacccgtaccgtaacgggaactaaaacttaccgaaaccgaacgtaacggtaccgtacgttaacttaccgtttaacgaaaacgtacgggtacgtaaccggtaccgtaaggaaccgtaggtaccgtacgggaaacgggacggtaaaccgggtccgttagttacgttaacgtttaccggtgggttaagggtacgggaagggtaaccgggtacgggtaagttaccgggaagggttacgggtcggttacggggtacgggtaaccgggg

SEQ ID NO: 268508 - DNA, 554 bp, Homo sapiens
  misc_feature: GYAE6OF02GDRBA.28.57.F02.1.454.CMB.1.raw
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagcctggggggtccctgagctctcctgtgcagcctctggattcacctttcagttatttatgctatgcactgggtccncaggctccgaggagggactggaatntgtctcaggtattagaataatgacgaataacatatattangacaaatctagtgaagggcagatcaccatctccgaggacattaccaagaacacgctagtatacttcaaatggacagcctgagagcgtagagacgacgctagtattaagttacgtggtacgggaggaggagtaccgggtaagttacgggaaccggttaggggtttacgggtacgggggacccggtaacgggg

SEQ ID NO: 268509 - DNA, 775 bp, Homo sapiens
  misc_feature: GYAE6OF02JASHD.28.57.F02.1.454.CMB.1.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggattcaccttcagttatttatgactatgctacgtgggtccnccaggtcctaccgaggggaacgggactagggaaatagtggttctacgagggttaattaagaaagttaanggacgaaataaacgattaagttattaatacgactaaaacttcgttaaggtaggaaacgggtctaagtaacgttacctaaacgtacgttacccgtacccgaagggtaaacctaaacgtttaaccccgaaaacgtaacccgtaaccggtacctttaaggttaaaccgtttacttaaccgtaaacggtacggggtacctaaccggtaccgtaggtaccggaacggtcgtaacgggaacgggaaccctacggggtacctttaaggttactttaacggtttacggttaacggggttaacgggggtaacggggtaaacggggtacggttaacggggttaaagggttaacggggttaaaccgggtttaggggggtttaccggggtacggggggtaaccggtaaccgggggg

SEQ ID NO: 268510 - DNA, 632 bp, Homo sapiens
  misc_feature: GYAE6OF02GXBEJ.28.57.F02.1.454.CMB.1.raw
  modified_base (286)..(286): a, c, t, g, unknown or other
  misc_feature (286)..(286): n is a, c, g, or t
  modified_base (552)..(552): a, c, t, g, unknown or other
  misc_feature (552)..(552): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgctatttttaaaggtgtccagtgtgaggtgcagctggtggagtcgtgggggaggcttggtccagccgtggggggtccctggagactctcctgtgcagcctctggacttccaccttcagttatttangctagtgctacgtgggtccaccgaggcctccggaaggggaagggactagggtaatagtcgtctacgaggttattaaggtaagtaagtgacgtaaataactattaattattaagtcgaactaaacttcgttaggtaggaacgggtctaaggtacttaccacgtacttcgtacccgtagggaaactaacttacccgaaagaaccgacgttctagttactacttaagaaacgtcgggactaggcctagagtagctaggacgacgacgtntagtattacttacgtggtagggtagagggtagacggttaaggttcggtaacggttagggggtcgtacggggactacgggg

SEQ ID NO: 268511 - DNA, 682 bp, Homo sapiens
  misc_feature: GYAE6OF02GN7XO.28.57.F02.1.454.CMB.1.raw
  modified_base (272)..(272): a, c, t, g, unknown or other
  misc_feature (272)..(272): n is a, c, g, or t
  modified_base (359)..(359): a, c, t, g, unknown or other
  misc_feature (359)..(359): n is a, c, g, or t
  modified_base (545)..(545): a, c, t, g, unknown or other
  misc_feature (545)..(545): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtcctgagctctcctgtgcagcctcgtggattccaccttnagttatttatgctatgcacgtcgggtccgccaggctccgaggggaggcgtaggaatagtgtctacgtaaggttacttaagaaagtangtacgaaataactattagtaacttagtcgaactaaaacttcttaggtaggtaacgggactaggtaacttccaaccgtaattcccgaccgaaggtaacctaaacgttaaccaaaggtaacctacggtacttaggttaaccttacgttaactaaagttcgggacctaggtaccgttggaagtaccggntacgggaacggtaccgaacggtccgttaagtttaaccgtaggttaccggttaggggtagggaacggttagggaacgggtaacggttaaggttaccgggtacggtttaaggggggtcgttacggggggctaacggggg

SEQ ID NO: 268512 - DNA, 781 bp, Homo sapiens
  misc_feature: GYAE6OF02G977N.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcgttggtccagccgtggggggtccctgagactctcctgtgcagcctctggacttcaccttcagttatttatgctatgcacgtgggtcccgccaggcctccgagggaacgggactaggaatagtgtctacgaggttatagaagtaatcgaacgtaataacataattaattagtacgactaaactctaggtaggaagggactagtacttaccaacctacgttacctacccggaacggtaacctaaacgttaccgaaaccgtaaaccgtaaccgtacgttacgttaacgttaccttaagtaaaacggttcgggtaacctaccggtacccgttaggaacggtaacggtaccgttaacggggaaccggggtaaacccgtaaccggggtaccgtttaacgggttaccgttttaaaggtttaccgggttaacggggttaagggggtaacgggtaaacgggggtaaaccggggttaccgggttaaacggggttttaacggggtaaaccggggttttaacggggggtttttaaccgggggttacccgggggggtaacccgggttaacccgggggggg

SEQ ID NO: 268513 - DNA, 739 bp, Homo sapiens
  misc_feature: GYAE6OF02IN7Z8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgctatttttaaaggtgtccagtgtgaggtgcagctggtggagtcgtgggggagtcgttggtccagccgtcggggggttccctggacgtacttcgtccgtggtcgcagtccgtcgtaggtcttccacctttcgaagttatttatggtccttagtcgccacggttcggtcccgaccgtacggccgttcggaagggaacggtactaggtaacgtagttcgtacgttacgtaacggtaacttaaggtaaagtaagtcggaacgtaaataacgtaagttaataactttaatagaaccttaaacgtttcgtaaggtaggaacgggtctaaggtaccttaaccaccgttataaccctaccggtaacggaacttaacgtaaccgaaaccgtaccgtacgtccttaagttaaccttacgttaagtaaaggtccgggtacacgtcccgtaaaggcgttaacggtaccgtagggaccggtaacgtaccgttagtcgttaccgttaagttcggtagggagggtaacgacgggttagtaccggtaagttaccgggtaagggtttaggggtcggttacgggaccggtacggg

SEQ ID NO: 268514 - DNA, 755 bp, Homo sapiens
  misc_feature: GYAE6OF02IW6CY.28.57.F02.1.454.CMB.1.raw
tcagagtacgctatcacgaccggtgctcgatttagctcgatatagttgggtctggagaggagcccccgcccgtcgggtttcccgaggtgttctcatttgggtgatcagccactgcactacagaagagtcatgacggagtttgggctgagcgtgggttttccttgttgctagtttttaaaggtgtcccagtgtgaggtgtcgagcgtggtggagtcgtgggggagcgttggtccagccttcgggggtccctggagactctcctgtgtctagtccgtcgtggtacttctaaccgttacagtttaagttttaacttggttacctaagtcgtacgtacgttcgggtccgaccccgaacgggtccctaccgaagggaacggtacgtacggaaactttagttggttacgtccgtaaggttatttaacggtaaaggtaacgttccggtaccgtaaactaaaccgtaattaacgttaattaacgtcgtaactaaaccgttcttacggtagtaaagggtccaagtacttacaacccattccaacgtacggactattacccgaagaacctcggtattacgttaacgttcgttaacaaggtacggtacgtacgtaccttaggacgttacgacccgttagaacggacctacgggtaaccttagttacgtttacggtttaccgtggggttaccggaaagggtcggaacggtagggttaacgttagggtaaccgtttagggggttacggtaccgggaaccggtacgggg

SEQ ID NO: 268515 - DNA, 693 bp, Homo sapiens
  misc_feature: GYAE6OF02GOR4R.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggaggcgttggtccaggccgtggggggtccctgagactctcctgtgcagcctcgtggattccaccttcagttatttatgctatgcacgtcgggtccnccgaggcctcgaggggaggactaggaatgtgtactcgtaggttataaggaagtagtgaacgtaaataacgattattaattagtagactaaactgtaggtaggaaggctagtattaccgactactccgtacggaaggtacctaaaccgttaccaaacggtaaacctcggtacttacgttacgttaccgtttaacgaaagggttccgggaactacccgggtaccgttaggaacggtacggtaccggtaagggaacgggaacctaacgggtacttaaggtttacttacggtttacggtacgggttacggggaagtaacggggtacgtacgggtaaggtttacgggtaacgggtttaggggtacgggttaccgggggacgtaaccggggg

SEQ ID NO: 268516 - DNA, 874 bp, Homo sapiens
  misc_feature: GYAE6OF02H7VBR.28.57.F02.1.454.CMB.1.raw
  modified_base (286)..(286): a, c, t, g, unknown or other
  misc_feature (286)..(286): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagcgtggtggagtcgtgggggaggtcttggtccagtccgtcggggggtccctggacgctctccgtggtcgcacgtcctctggacttcaccttnagttatttctagtcttatgaccgtacgtcgggtacccgcccgagggccctaccgggaaggggaaaccgggtacgtaggaaagttacttcggtacttacggtaaggtttaagttaaggtaaaagttatacggaaccgtaaaacttaacgtaattaatttaattaacgtacgtaacctaaacgttcgttaggtaacggggtaacgggtaactaacggttaccgtttaccctaaaccttacccgttacccggtaacccggtaaaccggggtaaacccttaaaccgtttaacccgaaaaacggttacccgtaaaccggtttccgttaacgtttacctttacccgttaagaaacgggttcgggtaccgtaacctcggttaacgggacggtacggttaccggacggaacgggtaacccggtacgggtttacgttaacgtttacgtttacggtttaacgggttccgggggttaagggaagggttaaacgggggaccgggttaaagggttaaggggttttaacccggggtaaagggggttttacggggggtttacccggggggttcgggggaaccccggggttaaaccccgggggg

SEQ ID NO: 268517 - DNA, 628 bp, Homo sapiens
  misc_feature: GYAE6OF02FMW42.28.57.F02.1.454.CMB.1.raw
  modified_base (340)..(340): a, c, t, g, unknown or other
  misc_feature (340)..(340): n is a, c, g, or t
  modified_base (376)..(376): a, c, t, g, unknown or other
  misc_feature (376)..(376): n is a, c, g, or t
  modified_base (524)..(524): a, c, t, g, unknown or other
  misc_feature (524)..(524): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccagccgttgggggggtccctggagactctcctgtgcacgcctctggattcaccttcagttatttatgctatgactacgtgggtcccgccgaggcctccgaggggaggacgtaggaatntggtctgaggttagtaagaagtaagtgacgaataanatattattatgactaaactctagtaggaagggacagtacttcacctatccgtaccgagggaactaacttacccgaaagaaccaccgtatacgttaacttcgttaacgaagtcgggacacggtcaggtacgagacgtaggacgggaccngggtactaggtacttacgttacggtgggtacggtaagggacggtaggtacgggtaattcggggtaaacggttaggggttcgggtacggggacggtaaccggggg

SEQ ID NO: 268518 - DNA, 227 bp, Homo sapiens
  misc_feature: GYAE6OF02H7TDO.28.57.F02.1.454.CMB.1.raw
  modified_base (222)..(227): a, c, t, g, unknown or other
  misc_feature (222)..(227): n is a, c, g, or t
tcagagtacgctatcacgaccggtgctcgatttagctcgatatagttgggttgtggggccagggagccctggtcaccgtctcctcagcctccaccaagggcccatcggtcttccccctggcgccctgctccaggagcacctccgagagcacagcggccctgggctgcctggtcaaggactacttccatagcgtactctgagcgggctggcaaggcgcatagnnnnnn

SEQ ID NO: 268519 - DNA, 810 bp, Homo sapiens
  misc_feature: GYAE6OF02JA4FV.28.57.F02.1.454.CMB.1.raw
  modified_base (289)..(289): a, c, t, g, unknown or other
  misc_feature (289)..(289): n is a, c, g, or t
  modified_base (343)..(343): a, c, t, g, unknown or other
  misc_feature (343)..(343): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgcttatttttaaggtgtccagtgtgaggtgcagctggtggagtcgtgggggagtcgttggtccagccgtggggggtccctggagactctcgtgtgcacgcctcgtggattccgaccttcgagtattttangtctatgtcacgtgggtacccgcgacggctccgaggggaacggactacggaatntgtctacgtaggttattaaggaaagtatacggacgtaaattaacgattaagtattaagtagtaacctaaaactccttagggaacgtaacggggtacctaaggtaactttaccgaacctaacgtttaccgtaacccggtaaaggggtaaccttaaaccgttaacccgtaaaacgaaacccgtaacgtccggtttaacggttaaaccttaaccgtttaaacgaaaacggttcccgggggaactaaccggtaacccgtacggtaaaggaccggttacccggtaaaggttaccggggaaacccgtaacggggtccctttaaaggtacgttaaaccgttttacgggtaacgggtttaacggggggaaacgaacggggtaacgggtaaaccgggtttaacggggttaaccggggtttaaaccgggttaaggggggttttccgggtaacggggggaacccggttaaccgggggg

SEQ ID NO: 268520 - DNA, 746 bp, Homo sapiens
  misc_feature: GYAE6OF02GOVTC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagacctctcctgtgcagcctctggacttccacctttcaagttatttatgacttatgctacgttcgggtcccgccgagggcctaccgaagggggaacggggaccgtagggaaacttagtgttctacgaagggttaattaaggaaagtaagtagacgtaaataaactaattaatttaatttaatagaacctaaaacttcgtaggtagggtaaacgggactaagtacttaccaaccctacttacccgtaccgaacgggtaactaaacgttacccgaaaacgaaacctacggacttacgttacttaccttaacgtaaaaggtcggggtaaccacggtccgtaggaacggtaggtacgtagggaacggaaccggtaccgggtacttaggttaatttaacgttacggttaggggtaacggggaaggtaacggggaacggtaacgggttaaggttacggggtaaacgggtttaggggggtttacggggtacggggggtaccggtaacgggggg

SEQ ID NO: 268521 - DNA, 894 bp, Homo sapiens
  misc_feature: GYAE6OF02JFO1X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggtagtttgggctgagcgtgggttttccttgttgcttaatttttaaaggtgtccagtgtgaggtgcagctggtggagtcgtgggggaggtcgttggtccgagcccggttcgggggggtccctggacgtacctccgtccgtgttcgcctacggccttcgtggtaactttcctaaccctttcgtaaggttttaattttacgttcgaccttaagttcgaccgtacggttccggggtccccgacccggtacgggtccctaacccgggaagggggaaacgggtacctagggaaattcggtagtccgtacgtaaggttaagttaagtaaagttagtaggaaccgtaaaacttaaacgtaagtttaaattagtttaacgtacgtaaacctaaaaccgttcgtaggtaagggtaaacgggtcgtaaacgtttacgtttaacccgaaaccctactttacccggaaacccgggtaaacggggtaaaaccttaaacccttaaacccggaaaaacggtaaacccgtaccggttaaactttacggttaactttaccgttaaacccggtaaaggccgggtaactaccgggtaaccttaggaacggtaccgtccggtaaaggtaaccggaaccggtacggtaccgttagttacgttaaacgttccggggttaaggggaacgggtaacggtaacggggtacgggttaaacggttaacggtttaaggggtaacgggtttagggggttaccgggggtaccgggggtacccgtaaacgggggg

SEQ ID NO: 268522 - DNA, 746 bp, Homo sapiens
  misc_feature: GYAE6OF02IONZH.28.57.F02.1.454.CMB.1.raw
  modified_base (254)..(254): a, c, t, g, unknown or other
  misc_feature (254)..(254): n is a, c, g, or t
  modified_base (542)..(542): a, c, t, g, unknown or other
  misc_feature (542)..(542): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccccgagctctcctgtgcngcctctggattcacctttcagttatttatgctatgcacgtcgggcccgccgacggcctccggaggggaacgggacgtaggaattatggtctacgtaaggttaattaagaagttaagtcgacgtaaataacaagttaattaatttaatcgaactaaaacgtcttacggtaaggtaacgggactaagtaactttaccgaaccctattacccgtacccggaaagggtaaacctaaacgtttacccgaaaacggaaaccgaccgtaacgtttagttaacttaccgtttaaanaaaacggtcgggaacctacggtacccgtaggaacggtacgtcgttaacgggaacgggaaccgacggtcgttagttaagtttacgtttaaggttggggaagggggaacggtaaacgggtcgggtaaacgggttaaggtttaccggggtaaacgggttttacggggggtttgggaccggggggtacccggtaagggggtaccccgg

SEQ ID NO: 268523 - DNA, 821 bp, Homo sapiens
  misc_feature: GYAE6OF02IX0Q1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagcgtggtggagtcgtgggggaggtcgttggtccacgccgtggggggtccctgagtactcctcctgtgcgacgtccttcgtaggtactttcctaaccctttcgaagttacttttaacgtcgtaccttagttgaccgtaccggttcggggttaccccggacccgtagggtccctaccccgggtaagggggaaacggggaccgttaagggtaaacttaggttaggtcccgttaacggtagggttaaacgtttaaaggtaaaaggttaaacgttaggaaccggtaaaaacgttaaaactaacgtttaaattaaagtttaacgtacgtaaaccttaaaaccgttcgtaaggttaacgggaacggggtactaacggtaacgttaccaacccgtattacccgtaccgtacgggtaaactaacgttaacccgaaacgtaaccgaccggtacgttacgttaacgttaccttaacgtaacgtacggggacacggttccgtagtacggacgtcggtacgggaaacgaccggaacgtaccggtagttacttaagttacggttagggtacgggacgggtaaggtacggtaacggtaaggttaacggttaacggttagggtcgggttacgggagggtaccgggg

SEQ ID NO: 268524 - DNA, 795 bp, Homo sapiens
  misc_feature: GYAE6OF02JE26U.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttccttgttgctatttttaaggtgtccagtgtgaggtgcagctggtggagtcgtgggggaggcttggtccagccgtgggggtccctgagactctccgtgtcgcgagcctcgtggattcaccttacagttatttatgacgtatgcctacgtcgggtccgaccgaggccgtaccgaacggggaacgggactaggaattacgtgttacctcgtaaggttaattaacggtaaagttaagtgtaacgaaaattaaacctaagttaaattaagtttaacgtacggtaaccttaaaaaccgtttccgttaagggttaagggaacggggtacctaaacggtaacgtttacccgaaacccgtaagttacccgtacccggaaacggggtaaactttaaacgttaacccgaaaacggtaaaccgtaaccggttacctttaaggttaacttaccgttaaactaaacgggtccgggtacgaaccggtccgttaagggaacgtaacggtaccgttagggaaaccggtaccgtaacgggtcgttaacgttaaccttagttaaccgggttgggaaccgggtaaggaacgggtacggtaacggttaaaggtttccgggtaaagggttacgggttcggggttacggggaccgggttaacgggg

SEQ ID NO: 268525 - DNA, 804 bp, Homo sapiens
  misc_feature: GYAE6OF02HI5LI.28.57.F02.1.454.CMB.1.raw
  modified_base (804)..(804): a, c, t, g, unknown or other
  misc_feature (804)..(804): n is a, c, g, or t
tcagagtacgctatcacgaccggtgctcgatttagctcgatatagttgggtttgggggtccctgagactctcctgtgcagcctctggattcaccttcagtattatgctatgcactgggtccgccaggctccagggaagggactggaatatgtctcaggtattagaagtaatgcgaataacatatattatgacaaactctgtgagggcagattcaccatctccgaggactaattccaagacacgctgtatcttacaaagtcggactacgcctagagagcgtaggacgacacggtctagtattagttaacgtgggtagggtacgagggtacgacgggtaagttacgggaacggttaggggtttcgggtacgggggtaccgtaaggggtacccgtaccccggtttagggttacccgtaaccccgggtttaccctacccggtaccggaacccggttcccccgttaaccccgaaacccggtaacccgggggtaccccctaccgggtttaccccgggttcccccctttcccccccggtaggggaccccccgttcccccggttaccggtaccccgttacccggaagggtaccccgtacccgtaaccccggtaccgggaacggaccgacccgtaaccggaccgggtccccgggacccggttcgggacccgttacgggtccgttacggtaaccggaacggttacccttaaccgttaccgtaacgtaccggtacccgttaccgtcggttaccggacgggtaccggtcgtacggtaccggaacggtccgacggtaacgtaccgacgtagaccgtn

SEQ ID NO: 268526 - DNA, 625 bp, Homo sapiens
  misc_feature: GYAE6OF02HXZ5M.28.57.F02.1.454.CMB.1.raw
  modified_base (342)..(342): a, c, t, g, unknown or other
  misc_feature (342)..(342): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcacgcctcgtggacttcaccttcagttatttatgctatgcactcgggtcccgccaggcctccgaggggaacgggactggaatatgtctnaggtattagaagtatgacgaataacatattaattatagacaaactctaggtaggaacgggactagacttacccaactacttccgtacccgaaggggtaacctaaacgttacccaaagaaaccacgtactagttactacttaacaaagtcgggcaacggcctagagagtcgtagacggacgaacggtcttagttagttaatacggtgggtaggggaaggtagggtacggacggtaagttacgggtaacgttagggggtttcggtacggggggacgtaacggggg

SEQ ID NO: 268527 - DNA, 739 bp, Homo sapiens
  misc_feature: GYAE6OF02ISYAP.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctgggtggagtcgtgggggagcgttggtccagccgtgggggtccctgagactctcctgtgcagcctcgtggtattccaaccttctagttatttatgtacttagtgcctacgtcgggtcccgccgtaggcctacggaaggggtaaggaccgtaggaaatgtgtactcgtaaggtattaagaacgtaagtagacgtaaataacgtataattaattagacgtaactaacttcgtacggtaagggaacgggtactaaggtaacttccgaaaccgtcttacccggacggtaacggtaaacttaaaccgtaacccgaaaacgtaacccgtaacgtaccgtttacgtaaaccttacgttaaaccgaaagggttacccgggacgttaaaccgcccggttaagaaccggacggttacgtaacgggaaccgggtacgtaccggtacgttagttaacctttaggttaccggaagggtaacggacgggtaaggtaacgggttaggaaacgttgggtaaaccgggtttgggccggggtagggtacccggtaaccgggg

SEQ ID NO: 268528 - DNA, 675 bp, Homo sapiens
  misc_feature: GYAE6OF02GWNYI.28.57.F02.1.454.CMB.1.raw
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagactctcctgtcgcagcctcgtggattccaccctttcagttatttatcgtctagtcgtcacgttcggggtcccnccgaggcctaccggaaggggaacgggactagggaatatgtctcgaggttattagaagtatgacgaaataacatatattatgactaactntgtaggaggcagtacttcacctatccgtacgaacgggaactaacgttaccaaacgtaacccacgtaccttagtaacttacttaacgtaaacggtcggggacctaccgggtacccgtaggaggtaaccgcgttacgggaacggtacgacgggtcttacggttaacttacgtttaccggtgggttacgggaaggtagggaacggttacgggttaaaggtttcggggtaaaccgggtttgggggttacgggtaccggggaccgtaacgggggg

SEQ ID NO: 268529 - DNA, 601 bp, Homo sapiens
  misc_feature: GYAE6OF02JJHQ6.28.57.F02.1.454.CMB.1.raw
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (482)..(482): a, c, t, g, unknown or other
  misc_feature (482)..(482): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttangctatgcactgggtccncaggctccagggaggctggaatatgtctcaggtattagagtatgacgaatacatatattangacaaactctgaggtaacgggnaaggtacttaccaacctataccgtccgaaggggtactaagttacccaaaggaaaccacgtcgttagtaacttcttacaaaagttcgggactagaccgttanacgaagcgttaggaggaacgtaccgggtatagttacttacgttacgtggggtaaggtaggacggaggtagggtaacgtttaggaacggtttaggggtcggtacggggaccggtacgggg

SEQ ID NO: 268530 - DNA, 839 bp, Homo sapiens
  misc_feature: GYAE6OF02JSW4K.28.57.F02.1.454.CMB.1.raw
  modified_base (171)..(171): a, c, t, g, unknown or other
  misc_feature (171)..(171): n is a, c, g, or t
  modified_base (248)..(248): a, c, t, g, unknown or other
  misc_feature (248)..(248): n is a, c, g, or t
  modified_base (340)..(340): a, c, t, g, unknown or other
  misc_feature (340)..(340): n is a, c, g, or t
tcagagtacgctatcacgaccggtgctcgatttagctcgatatagttgggtctgggagaggagccccgccctgggtttcccaggtgttctcatttggtgatcagcactgcacacagaagagtcatgacggagtttgggctgagctgggttttccttgtgctattttaaggngtccagtgtgagtgcagctggtcggagtcgtgggggagcgttggtccagccgtggggggtccctgacgactctccgngtagcacgtcctcgtggattcaccttcagttattatgtctagtcgctacggtcgggtcccgaccgtaggccgttaccggagggtaacgggtntagggtaaatcgtcgtaccctggtaaggttaagttaacggaaaggttaaagtcggtaacgtaaaacgttaacctaagttaaagtttaacgtttacggtacgtaaaccgtaaaaccttcggttaacggtacgggtaaaacggggtactaacggtaaaccgtttacccgaacccctaaagttaccccggtaacccggtaaacggggtaaccctttaaacggttaaaccccgaaaacggtaaaccccgtaaccggttccgtttaacgggtaacgtttacccttaaaccgaaagggtttaccgggacgtaccgtaccggttaagacggaaccgttcggtagggaacccggacgttacggacgttaccgtaagtttaccgtaacgggttacgggtaaggggtaacccggaaagggggttacccggacgggttaacgggtttaaaccgggttaaccgggtttagggggttaccggggttaaccgggggaccggttaaaccggggg

SEQ ID NO: 268531 - DNA, 576 bp, Homo sapiens
  misc_feature: GYAE6OF02F9OE2.28.57.F02.1.454.CMB.1.raw
  modified_base (298)..(298): a, c, t, g, unknown or other
  misc_feature (298)..(298): n is a, c, g, or t
  modified_base (469)..(469): a, c, t, g, unknown or other
  misc_feature (469)..(469): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcactgggtccncgaggctccgaggggaaggactggaatatgtctcaggtattagaagtatgacgaataacataatattatgacaaactctgtagagggcaagtattccactatctcgaacgggactaattaccaaagaccacgtacttacgtaatcttacaaagtcggcacgcctgacggancgtaggaacggacaacggcttagtatatttacgtggtagggaaggtagggagtacgggtaagtttacggaaacggttaggggtttggcgggggtaccgtaacggggg

SEQ ID NO: 268532 - DNA, 582 bp, Homo sapiens
  misc_feature: GYAE6OF02FE3WB.28.57.F02.1.454.CMB.1.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (473)..(473): a, c, t, g, unknown or other
  misc_feature (473)..(473): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggagcttggtccagccgtggggggtccctgagactctcctgtgcagcctctggacttcaccttcagttattatgctatgcacgtggccncgaggctcgagggaggactggaatatgtctcaggtattagaagtatgacgaatacatatattancacaactctaggtagaagggcagtacttcacctctcgtaccgagggacctaacgtaccaagaaccacgtctagttactaccttaagaaggtcgggacacgccgtaggaacgnggtacgtagaacggactacggnttagttanagttacggtcgggtgggaaggacggtagaacggtaagttacgggtaacggttaggggtcggtaggggaccgtaacgggg

SEQ ID NO: 268533 - DNA, 815 bp, Homo sapiens
  misc_feature: GYAE6OF02IHYJD.28.57.F02.1.454.CMB.1.raw
  modified_base (311)..(311): a, c, t, g, unknown or other
  misc_feature (311)..(311): n is a, c, g, or t
  modified_base (732)..(732): a, c, t, g, unknown or other
  misc_feature (732)..(732): n is a, c, g, or t
tcagagtacgctatcacgaccggtgctcgatttagctcgatatagttgggtcgtgggagaggagcccccgccctgggtttcccaggtgttctcagtttggtgatcagcactgcacacagaagagtcatgacggagtttgggctgagctgggttttccttgtgcttattttaaggtgtccagtgtgtagggtgcagctgggtggtagtcgtggggaggtcttcggtccaggccgtcgggggggtccctgacgtacgtctccgtggtgcgacgtcctcgtaggtacttccgtaccttcgaagtttacttttangtaccttatacgtcgtaaccggttccggggtacccgacccgggtaaggtcccgttaccgggaaacgggggtaacgggggtaccctttaaaggggtaaacttacgtttaacggtccttaacggttaaaggttaaagtttaaacggtaaaacgttaagttccggtaagttaaacctaaaagtaactttaagttaaagttaaacttaggaaaccccttaaaatttccgtaggtaagggtaaaccggggcttaaaggtaactacccgtaacccgtacgttaccctaaccggtaaaccggtaaactaaaccttaacgaaaacaccgtaacgtcttaagtaccttactaacgaaacgttcggataccggacgtacgaagcgtacgtagaccggtaacgtaccgtacgtagttacgttatttaacggngggttaggaagggtaaacgggacgtaagggttaacggtacgggttaaacggtaggggtcgggtttaaccgggcggtaacgggg

SEQ ID NO: 268534 - DNA, 703 bp, Homo sapiens
  misc_feature: GYAE6OF02HXZN1.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagcctggggggtccctgagactctcctgtgcagcctctggattccaccttcagttatttatgtctatgctacgtgggtcccgccacggctaccggaggggaagggactggaatatcgtctcgaggtattagaagtaagtgacgaaataacatatattatgactaaactctaggtagaagggcagtacttccgaacctacgttcctaccggaagggtactaaacgttacccgaaacggtaaacctaccggtcgtttagtactttaccgttaacgaaacggttcggggactaacggcccgttagggtaaccgacggtaccgttcgggaaaccgggtaccgtaacccgggtatttacgggtttaattacggttttacggtggggttaacggggaagggtaacgggtacggtaaggggttaacgtttaacggggtaaacggttgggggggtttaacgggccgggggggtaaccgtaaccgggggg

SEQ ID NO: 268535 - DNA, 618 bp, Homo sapiens
  misc_feature: GYAE6OF02I5136.28.57.F02.1.454.CMB.1.raw
  modified_base (394)..(394): a, c, t, g, unknown or other
  misc_feature (394)..(394): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctccgtgtgcagcctcgtggattccaccttcagttattttatgcttatgcacgtgggtcccgccaggcctccgagggaagggactggaatagtcgtactcgaggttattaagaagtaatgacgaataaacataatattatgacaaactntgtagaagggcaagtattaccactactccgtaccgagggactaaacttaccaaacggaaacaccggtacttacgtaacttaccttaaccgtaaagtcggggaacacggtaccgtaggtaaccgaggtctaggaacggacgacggtctagtacttagttacgtagggtgggaaggaggacggaaggtacgttaggaacggttagggtagggtgggacgtacgggg

SEQ ID NO: 268536 - DNA, 785 bp, Homo sapiens
  misc_feature: GYAE6OF02HJ01F.28.57.F02.1.454.CMB.1.raw
  modified_base (172)..(172): a, c, t, g, unknown or other
  misc_feature (172)..(172): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggttttcctgttgctattttaaaggngtccagtgtgaggtgcagctggtggagtcgtgggggagtcgttggtccagccgtggggggtcccctggagactctcctgtgcagcctcgtggattccgaacctttcgaagttattttaactggtccttaaattgaccgtaacgttcggggtcccgaccgaagggtccttcccggaagggaacgggtacgtacgggaatttacgttacgtcgttacgtaacggttatttaaacggaaacgttaaacgtggaacgtaaacgttaaaccaagttaacgttaattagttacgacgtaaaacgttcgtaaggttaacggaagggtacccaagttaacgttacctaaccgtaacgttacccgtaaccggtaacgggtaactaaacgttaccgtaaacgaaccgtaacggtacgtcgttaaacttcgttaaacaacgttcgggacctagggtaccgtaggaaccgttaggtaccgtcggtaaacgggtaccctaacggtacgtttaacgtaacgttaacggtttacgtagggtacgggtaaggtaacgggaacggttacgggtaacgtttacggggtaaacggttacggggtttacggacgggggttaccctaacggggg

SEQ ID NO: 268537 - DNA, 856 bp, Homo sapiens
  misc_feature: GYAE6OF02GIROX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcgtgggttttccttgttgcttaatttttaaaggtgtccagtgtgaggtgcagcgtggtggagtcgtgggggagtctttggccaggtccgtgggggccctgagcctcgtctgtcgcacgtcctcgtggtacttcgacccttgaattagtttagtgtactagtgaccgtacggttcggggtcccctaccggacgggttcccgtaccggtaagggggtaaccgggtaccgttagggaaacgtttaacggttcggtaccgttacgtaaaggggtttaactttaaacggggtaaaacggttagtaacggtaaacccggggtaaaatttaaaaccggtaaactttaaatttaaaggttaaaccttacggggtaaaccccttaaaagttcccgggttttagggaaacggggtttaacccgggaattaagggtaaacccgttaacccgttaacccgtacgttaccccttaaccgggaacgggttaaacccttaacgttaaacccgaaacgtaacgtaccgtacgtagttaaacccttacgttaacgtaaacggtccggtaaacgtacggtacgttaacgggtacgacggttactacggggaacgaaccggttagtaccgttacgttagtaccggttacggttaggaacgggtaacggtaaggtacgaagggttaccgttagggtaaccgttggggtcgggttacgggacccggtacggg

SEQ ID NO: 268538 - DNA, 783 bp, Homo sapiens
  misc_feature: GYAE6OF02FGCXF.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgcttatttttaaaggtgtccagtgtgaggtgcagctggtggagtcgtgggggaggcgttggtccagcccgttggggggtccctggagacctctccgtgtgcagcctctggattcaccttcagttatttatgctatcgacacgttcgggtcccgccgtacggcctaccggaaggggaacgggacgtagggtaaattagtcgttacttacgtaagggttaacttaagaagttaatcggtaacgtaaactaactaattaattaatttaactcgaacctaaaacttcgtaggtacgggtaacgggctaagtacttaccgaacctagtccctaccggtaacgggaactaacgttaacccaaacggaacctaccggtactagtttaacttacccgttaacgtaaacggttccggggaacctaacggtcccgttaagggaaccggtaacggttaccggtaagggaacggtaaccggaccggggttacttaacgggttaattacgttaaccggttaggggtacgggggtaagggtaacgggtaacgggtaacggggtttaacggttaacgggggttaaaccgggttttacgggggtttacggggaccggggggttacccggtaacggggg

SEQ ID NO: 268539 - DNA, 737 bp, Homo sapiens
  misc_feature: GYAE6OF02FJ8AN.28.57.F02.1.454.CMB.1.raw
  modified_base (366)..(366): a, c, t, g, unknown or other
  misc_feature (366)..(366): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagcccgttggggggtccctgagactctcctgtgcgagcctcgtggattcaccttcagttatttatgtctatgcacgtggtccgccgaggcctccgaggggaacggctaggaatagtgtctcgaaggttattagaaagttaacncgtacgtaaataaactaagttaactttaatttacgtacaacgtaaaactttcgttagggttaacggaacggggtaccaagtaacttacccgaaccctaccgttaccgttacccgtaaacggggaactaaaccgttaaccgaaacgaaccgtaccgttaccgttacgttacttaccgttaacgtaaagtacgggaccgtacgtaccgtgaacggtacgacgttacggaacgacgtacggtaccgttacgttattaacgtttacggtttacgggtagggtaacggtaacgggtaacgggtaacggtaacggttacggggttaaaccgggtttagggggtttacgggttacgggggtaccgggttaaccggggg

SEQ ID NO: 268540 - DNA, 673 bp, Homo sapiens
  misc_feature: GYAE6OF02F0NI0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctggagactctcctgtgcagcctctggattcaccttcagttatttatgcttagtgcacgttgggtcccgccgagggcctccgaaggggaacggggaccgtagggaaatagtcggtctcgtaaggttaacttaaggaaacgttaatgaccgaaataacgattaattaattagtacgaactaaaacttcgtaggtaggaagggcaagtacttaccgacctatcctaccgaagggaactaacttaccgaaacgaacacgtctagtacttaccttaagaacgtgggacacggtccaggaacgacggtcgtagggaacgaccgacgggtaccgttagttaacgttaacgttacggttgggtaaggggacggtaagggacggtacgggttaagttcggggtaaacggtttggggttagggtacgggggaccgtaacggggg

SEQ ID NO: 268541 - DNA, 741 bp, Homo sapiens
  misc_feature: GYAE6OF02HWML3.28.57.F02.1.454.CMB.1.raw
  modified_base (287)..(287): a, c, t, g, unknown or other
  misc_feature (287)..(287): n is a, c, g, or t
  modified_base (340)..(340): a, c, t, g, unknown or other
  misc_feature (340)..(340): n is a, c, g, or t
  modified_base (385)..(385): a, c, t, g, unknown or other
  misc_feature (385)..(385): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtctgggggaggcttgggtccagccgtgggggggtcccctgagactctcctgtgcagcctctggattcaccttcagttattttangactatgcactcgggtccgccaggcctccgaggggaacgggctagggaatagngtctcagggtattagaagtaatgacgaataacatatattatcganaaactctgtaggaagggtcaaggtattacgaaccctattacctaccgaagggaactaaacgttaccgaaacgaaaccaacgtaccttagttaacttcctttaaccaaaagtaccggggtacaaccggtcccgttacggaaacggtacggtaccgttacggaacgggtaaaccggaaaccgggttacttacggtttaattaaacgtttttaacccggttggggtttaaccgggggggtaaggtaccgggggtaacgggtaaccggggttaaacggtttacgggggtaaaaaccggttttaacggggggggttttaggggtttaacccggggggggccccgggttaaacggggggggg

SEQ ID NO: 268542 - DNA, 791 bp, Homo sapiens
  misc_feature: GYAE6OF02JZBBC.28.57.F02.1.454.CMB.1.raw
  modified_base (637)..(637): a, c, t, g, unknown or other
  misc_feature (637)..(637): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcgttgggttttccttgttgcttaagtttttaaaggtcgtcagtgtgaggtgcagcgtggtggacgtcggtgggggagtcgttcggtccgaggtccgggttcggggggttcccctaggtacggtaccttccgttcccgtggttcgacctaccggtccttcgtaggtactttaccgtaaccctttgtaagtttaacgttttagtcgtacgttaatcggacccgtacgggtccgggttccccggaccggtacggtcccgttaaccgggaacgggggaacggtacgttaaggtaacttgttacgttctagtaaggttagttaaagaaagttaacgtacggtaactaaataacgtaattaattaaagtttacgaacgtaaactaacgttcgtaagggtacggaacggtactaacgtacttaccgaaccttacgtaccgtacggaacgtaaccttaaacgtaacgaaacgtaccagttctaacttcgtactacggaanccggtactaacgccgtagacgtacggacgtaaggacggaacgtcgtacgttatacgttaggttaccggtgggaagggttaacggaacggaacggttagttaagggttaaccgggtacgggttaggggtttaccgggacgggacggttaaccggg

SEQ ID NO: 268543 - DNA, 903 bp, Homo sapiens
  misc_feature: GYAE6OF02HSFHG.28.57.F02.1.454.CMB.1.raw
  modified_base (707)..(707): a, c, t, g, unknown or other
  misc_feature (707)..(707): n is a, c, g, or t
  modified_base (821)..(821): a, c, t, g, unknown or other
  misc_feature (821)..(821): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaggtgtccagtgtgaggtgcagcgtggtggagtcgtgggggagtcgttggtccaggccgttggggggtccctggacggtactcttccgtggtcgcctacggccttcgtgggtactttccacccgttttcaaggtttacttttaagtcggtactttaacgtcgtaccgtaaccggtttcgggggtcccccgtacccgaacggggtcccgttacccgggaaaggggggtaaacggggtaccgttaacggggtaaaatttacggtttcgggttacccgttacggtaagggggtttaaactttaaacgggtaaaaggtttaacgtacgggtaaccggttaaaacttaaacgaatttaagtttaagtttaagttacggtaaccttaaaacgtttccggtacggttaagggaacgggttacgtaaaggttactttaaccccgaaccgtaacgtttaccccgtaccggtaagggtaacctaaaccgttaacccgaaaacggaaaccctaggttacccgtttacgttaacttaccccgtttaaanaaacgggttccggaaccgttacggacccgtaaggtaccggtacggtaccgttacgggaaccgggaaaccgtaaccggggtcctttaaaggtaccgtttaacggttttaccgggngggttaccggggaaggtaagggttacgggaaggttacggttaagggtaccggtttagggggtgtaccggggacgtaacgggg

SEQ ID NO: 268544 - DNA, 685 bp, Homo sapiens
  misc_feature: GYAE6OF02IWXKT.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctggagcttgggttttccttgttgcttatttttaaaggtgtccagtgtgaggtgcagcgtggtggagtcgtggggggaggcttgggtcccaggccggttgggggggtcccctggacgactcctccgtgtgcacgcctcgtggacttccgtaacctttcgaagttattttactgtcttagtgactacgttcgggtcccgcccgtacggccgtaccggaaggggaaacggggaccgtaggaatagttcgtcgtacgtaggttaattaaggtaaagtaagtgacgtaaataacgtattaacttaattatagactaaaacttcgtaggtagaagggtactagtacttaccactacgttccctacggaacggtaactaacttaaccgaaagaaccgacgtcgttaacgttacttctaacgtaaagtggtcacgtcgagacgacgtacgagtacggacgtcgggattaggtattaagtcgtagggtacggaagacggtagggacggttaacgtacgggtacggttagggtaggggtaccgggacggtacggg

SEQ ID NO: 268545 - DNA, 608 bp, Homo sapiens
  misc_feature: GYAE6OF02GXWN3.28.57.F02.1.454.CMB.1.raw
  modified_base (302)..(302): a, c, t, g, unknown or other
  misc_feature (302)..(302): n is a, c, g, or t
  modified_base (395)..(395): a, c, t, g, unknown or other
  misc_feature (395)..(395): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagttatttatgctagtgcactggggtcccnccaggcctccgaggggtagggactgggaatagtgttctcgtaggttattaaggaagtaatgacgaaataacataagttattatgactaaactntagtaggaagggcagacttacacactctcgaagggtactaaattaccgaaagaacacgactgttacttctactaaagtcggacacgaccgtagacggagtcgtagacgggacacgggtcttagtacgttattacggtgggtagggtaacgagggtaggacggtaaggttacgggtaacggttagggggtttaggtacgggggacgtacggggg

SEQ ID NO: 268546 - DNA, 526 bp, Homo sapiens
  misc_feature: GYAE6OF02FGHSA.28.57.F02.1.454.CMB.1.raw
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggtttttccttgttgctatttttaaaggtgtccagtgtgaggtgcagctggtggagtctggggggaggcttggtccagcctggggggtccctgagactctcctgtgcagcctctggattcaccttcagtatttatgctatgcactgggtccgccaggctccgaggggaaggactggaatatgtctcaggtattagaagttaatgcgaataacatatattatgacaaactctgtgaagggcagattcacatcctccgagggacaaattaccaaagaacacgctgtatcttcaaatgggacagcctgagagctgagacacgctgtatatacgtgtgggagaggagcgggaattggaacttgggtggtggggccgaagggg

SEQ ID NO: 268547 - DNA, 663 bp, Homo sapiens
  misc_feature: GYAE6OF02HP17C.28.57.F02.1.454.CMB.1.raw
  modified_base (289)..(289): a, c, t, g, unknown or other
  misc_feature (289)..(289): n is a, c, g, or t
  modified_base (439)..(439): a, c, t, g, unknown or other
  misc_feature (439)..(439): n is a, c, g, or t
  modified_base (534)..(534): a, c, t, g, unknown or other
  misc_feature (534)..(534): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttcctgttagctattttaaggtgtcagtgtgaggtgcagctggtggagtcgtgggggagcgttggtccaggccgttgggggggtacccctggacgaccttcgtcctggtgacagcccttcgtggtacttccaccctttnagttatttagtctgtatgctacgttcgggccacaggtcctaccggagggtaaggtactaggaatacgttcgtctagtaaggttaataaggtaagtaagtacgtacgtaaactaagaattaatttaaacttagtaacgaactaaaacgttntaggtaggaaaggcctaagtacttaccgaaactcgtactaccggaagtaactaaactacccgaaaagacgtacgcttacgttactaaccgttaanaaaggttcgggacacggtacctaggacgtacgacgtagggaccgacggaagttccttaggtattcgttagtggaacggtgacggaggtacgtaggtacggtaggttgggtgggtacggacggtaacggg

SEQ ID NO: 268548 - DNA, 855 bp, Homo sapiens
  misc_feature: GYAE6OF02HRQTN.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcgttggtccagccgtggggggtccctgagactctcctgtgcagcctctggattccaccttcagttatttatgctatgcacgtcgggtcccgccgacggctccggaaggggaacgggactaggaatagtcgtctacgaaggttaattaagaaagtaatgtacgtaaataaactaattaattaattatagaactaaaactcgtaggtaggaaggggtcaaggtactttaccaacctaacttccccgtaaacccggaaacggggtaaaccttaaaaaccgttaaccccgaaaaacggtaaaacccctaaccggttacccgttttaacggttaaacttttaccccgttttaaaaccgaaaaaacgggttccggggggaaccctaaacggggttaccccgttaagggtaaaccggacggttacccggttaaggggaaaccggggtaaacccgtaaccggggttacctttagggtttaaccgtttaaacggttttaaccgggtttaagggggttacggggggaaaacgggtaaggggtaaccggggttaaacggggttaaaacgggttttagggggaaaaacccggggtttttagggggggtttaccgggggttaccggggggggacccggtaaacccgggggggg

SEQ ID NO: 268549 - DNA, 636 bp, Homo sapiens
  misc_feature: GYAE6OF02HWJ8W.28.57.F02.1.454.CMB.1.raw
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
  modified_base (524)..(524): a, c, t, g, unknown or other
  misc_feature (524)..(524): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaggtgtccagtgtgaggtgcagcgtgggtggaggtcgtggggggaggtcgttggtccaggccggtgggggggtcccctggagtacctctcctggtcgcagtcctcgtggtacttccacctttcagttatttatgctatgcctagttcgggtccnccgtaggcctaccggaaggggaacggtactaggaattatgtctacgtaggtaattagaagttacngactaataacattatattatcgactaactctaggtagaagggtcagtactaccactaactcctaacgaggaactaactaaccgaagtaaccactacgtagttactacttaagaagtcggacacgactgagtcncggagtacggaccaggtctagttatacgtttaggcgggtagggaagtacgggaacggtacggtaaggttaggggaaccgggtttaggggtcgggtacgggccgggtaacggg

SEQ ID NO: 268550 - DNA, 562 bp, Homo sapiens
  misc_feature: GYAE6OF02I4AGU.28.57.F02.1.454.CMB.1.raw
  modified_base (371)..(371): a, c, t, g, unknown or other
  misc_feature (371)..(371): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcaccttcagtatttatgctatgcacgtgggtcccgcaggcctccgagggaagggactggaatatgtctcgaggtattagaagtaatgacgaataacataatattangactaaactctagtgaagggcagattcaccatctccgagggaacaattaccaaagaacacgtactagtactcttacaaagtcgggacagcctagagagctaggagacgacgctagtatagttacgtggtaggacggaaggtacggaggtaagttgggaacgttaggggttggtaccggggacgtacggggg

SEQ ID NO: 268551 - DNA, 646 bp, Homo sapiens
  misc_feature: GYAE6OF02FRW70.28.57.F02.1.454.CMB.1.raw
  modified_base (339)..(339): a, c, t, g, unknown or other
  misc_feature (339)..(339): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagtcgttggtccagccgtggggggtccctgacgactctcctgtgcagcctcgtggacttcaccttcagttatttatgctatgcacgtcgggtcccgcgaggcctccgaaggggaagggactggaaatntgtctcgtaggttatagaagtaatggacgaataacattaatattatacgaactaaactcgtaggtaggaacgggtacagtacgtttacaccctaagtccctaccggaggtaaactaacttaccgaaacgaacctacggtacttacgttaactccgttaacaaaggtcggccaagtccgtacggagtaccgtgtacggacggacctaacgcgttaagtacttacgttacggtggtacggggagtaacgggacgtaaggggtaacgtacgggttaacggttagggttcggggacgggaccggtacgggg

SEQ ID NO: 268552 - DNA, 786 bp, Homo sapiens
  misc_feature: GYAE6OF02ILKUR.28.57.F02.1.454.CMB.1.raw
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
tcagagtacgctatcacgaccggtgctcgatttagctcgatatagttgggtcgtgggaggaggagcccccgcccctcgggtttccctaggtgttctcatttggtgatcagcactgcacacagaagagtcatgacggagtttgggctgagctgggttttccttgttgctatttttaaaggtgtccagtgtgaggtgcagctgggtggagtcgtgggggaggcttggtccgagtccgtggggggtccctgaggactcgtcctgtgcagcctcnggnttcacttcagtatttatgctatcgcgtaccgtcggggttacccgcccgacggccttaccgaggggaagggtaccgtagggaattaacgttgttctacgtacggttaattaaggaaagttaaagcgacggtaaataaccaagttaacttaatttagtagtaccgtaaaacttccgttagggacggtaaaggggtccaataagttaccaacctacgttactaccggaacggtaagtaaaccttacgaaacgaaaccgtacgtaccgtacgttactaacgttacgtaaaaacggtcgggtaccgtaacggtcccgttaaggacgtaaccgtacgttagggaaacccggtaaccggacccggtaacgtttacgttaacgtttaaccgttcgggttaacggggtaggggtaaccgggtaaaagggtcggggaaaaccgggtttaggtttaaaaccggggggttacttaaacgggggggtttcgggtaccggggggggttaaccgtaacccggggggg

SEQ ID NO: 268553 - DNA, 915 bp, Homo sapiens
  misc_feature: GYAE6OF02H6SBY.28.57.F02.1.454.CMB.1.raw
  modified_base (267)..(267): a, c, t, g, unknown or other
  misc_feature (267)..(267): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcgagctggtggagtcgtggggggagcttggccagccgtcggggggtcccctggagactcctccgtgtgcagccctntaggattcctaccttacgagttatttactggtacttagtgcctacgttcgggtcccgaccgtacggtccttaccggaaggggaaacgggtacgtaggtaaacttacgtcggtttacctacggtaaggttaagtttaaacggtaaaagttaacgttacggaaaccgtaaaactttaaaccgtaagttaaacgttttaactttaacgttaagtaacccgttaaaaccgttccggtttaagggttaaaccggggaacggggtaacccgtacggtttaaaccttacccctaacccgttaacgttaccccgttaaacccgggtaaacgggaaacccttaaaacccgtttaaccccgaaaaaaccgggtaacccttaaaccgggccgttttaaaccgggtttaacgttaacccgtttttaaacgaaaaccggggttacgggttccaaaccgggtttacccggtaacggtaaggtaacccggttaacggttaacgggtaaaccgggtaccgtaaccggttaccgttaacgttaacgtttaacgtttaaccgggtcgggttaagggggtacggtaagggtaccgggtaacgggttaacgttaagggtaaccggtttaggggggtttaccggtcggggggtaaccgtaaccgggggg

SEQ ID NO: 268554 - DNA, 776 bp, Homo sapiens
  misc_feature: GYAE6OF02IQXJR.28.57.F02.1.454.CMB.1.raw
  modified_base (256)..(256): a, c, t, g, unknown or other
  misc_feature (256)..(256): n is a, c, g, or t
  modified_base (289)..(289): a, c, t, g, unknown or other
  misc_feature (289)..(289): n is a, c, g, or t
  modified_base (412)..(412): a, c, t, g, unknown or other
  misc_feature (412)..(412): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttattttaaaggtgtccagtgtgaggtgcagctggtggagtcgtgggggagtcgttggtccagccgtgggggtccctagagctctcctgtcgcngcctcgtggtacttcacttcgagttattttacngccttatcgtctacgtcgggttcccgccgtaaggcctaccgagggtaaaagggtcctaggaaacttagtcgtacgtacgtagggttaacgttaagaaagttaagtacgacgtaaaacttaaanatttaaagtagttaaacttcgaaacgtaaaactttccgtaggaacgggtaaaacggggtactaacggttaacgttaccaaaccgtaacgtccccgttaaaccgaacggggttaactaaaccttaacccggaaaaggtaaacccacggtaactacgtttaacgtacctttaaacgaaaggtccggactacgaccgttaagacggtaactacgttcgaacggtaccgaacggtaccttaggtaactttaaccggttacgtaacggggttagggtaaacggtaacgggtaccgggtaagggttaaccgttacgggtaaaaccggttaacggggggttccgggtacgggggtaccccgtaaacggggg

SEQ ID NO: 268555 - DNA, 770 bp, Homo sapiens
  misc_feature: GYAE6OF02HUZC9.28.57.F02.1.454.CMB.1.raw
  modified_base (297)..(297): a, c, t, g, unknown or other
  misc_feature (297)..(297): n is a, c, g, or t
  modified_base (438)..(438): a, c, t, g, unknown or other
  misc_feature (438)..(438): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctggtggagtcgtgggggaggtcgttggtccagccgtggggggtcccctggacgactcgtcctgtcgcagcctgtggattccgaccttcaagttattttangtacttagtgactacgtcggggtcccaccgaggcctaccggaaggggaacgggacgtaggaattacgttgtactaccgtaaggttaattaaaggaaagttaagtaggaaccgtaaaataaacgaagttaataagtttaacncgaactaaaacttcgttaggtaggtaaagggtctaacgttaagttacccaacgtaacgtttcccgaaccggaggtaaacctaaacgttaccgaaagaaacctacgtcttagttaacttaccttaacgaaaggttcggactaccgggtaccgtaggtaacgacgtacgttaggaaccggtacgaaccgggttagtttagttaacgtttaacgtttaccgggtaagggttaacggggaacgggtaacgggtacggtaacgggttaaacggttacgggggtttaaacgttagggggggtttaccggtttaccgggggaccggttaaccggggggg

SEQ ID NO: 268556 - DNA, 644 bp, Homo sapiens
  misc_feature: GYAE6OF02IW6HB.28.57.F02.1.454.CMB.1.raw
  modified_base (509)..(509): a, c, t, g, unknown or other
  misc_feature (509)..(509): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattccaccttcagttatttatgcttatgcacgtgggtccgccaggcctcgagggaagggactggaatagtgtctcgtaaggttattaaggaacgttatggtacgaaataacattaattattatgaactaactcgtggtagaagggcaagtacttacactatccgtacgaaggtaacaattacccgaaagtaaccgacgtacttagttacttcttaacgaaacgtcgggactacgaccgtggaacgngaccgtaggaacggacgaacggtctagttacttagtttacgtagggtagggtaagggtaaggtacgggacggttaaggttaacggggtaaccggtttaagggggttcggggtacgggggtacccgtaacgggggg

SEQ ID NO: 268557 - DNA, 714 bp, Homo sapiens
  misc_feature: GYAE6OF02JXV1X.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttggggttttccttgttgtcttatttttaaaggtgtccagtgtgaggtgcagctgggtggagttcgtgggggtaggcgtttcggtccgacggccggttcggggggttccctggacgtactcctccgtgtcgcacggtccttcgtaggtacttacctaccttcgtaagttattttacgtgtacttagttgccgtacggtcggggtcccgacccgtggacccttaccggaagggggtaacgggtacgttaacggtaattagttcggtacctacggtaaggttaattaaggaagttagtacgaacgtaaataactaagtatttaattacgtacaacgtaaacgtcgtaggtaagaggtctagtactactaacctgtactacggaacgtaactaactaacgaaacgaactacgtactagtactactaacgagtacggacacgactacgagcgacgtacgaacgacggtacgtcgttaagtacgttaagtacggtcggggtaacggtagggaacggttacggtaggtaaacggttcggtaaacgggttagggtccgggtaggtaacccgtaggg

SEQ ID NO: 268558 - DNA, 622 bp, Homo sapiens
  misc_feature: GYAE6OF02JI8XU.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggcttggtccaggccgtgggggggtccctggagactctcctgtgcagcctctggattcaccttcagttatttatgctatgcacgtcgggtcccgccgaggcctaccgaggggaagggactaggaatagtgtctcgaggttattagaagtatgacgaataacatatattatgactaactgtgtagaaggcagtactcaccatcctacgaaggtactaactaccaaagaaccacgtctagtacttacttaacgtaaagtcgggacacggtcctaggaagacggtacgtaggaacgggtaaccaccgggtacttagttacttaacgttcggtagggtagggaaggtaagggaacggtacggttaagttacgggtaaaccggttggggttacgggtcggggacccgaaggggg

SEQ ID NO: 268559 - DNA, 626 bp, Homo sapiens
  misc_feature: GYAE6OF02IXBHH.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtcagtgtgaggtgcagctggtggagtcgtgggggaggcttggtccagccgtgggggggtccctggagactctcctgtgcagcctctggattcaccttcagttatttatgtctatgctacgtcgggtccgccacgggctaccggaggggaacgggtacgtagggaatagtcgtctcgtaggttaattaagaagtaatgacgaaataacgattaagttattatagactaaacttctgtaggaagggacaagtacttaccacctagtcctaccgaagggaactaacttaccaaacgacacgtctgttaacttccttaacgaaggtcgggactacgactaggacgagcgtaggacggaccgacgcgtagtattacgttacggtggtagggtaggaagggaggacggttaagttacgggtaaacggttagggttcgggtcggggtaccgtacgggg

SEQ ID NO: 268560 - DNA, 935 bp, Homo sapiens
  misc_feature: GYAE6OF02HQ7B0.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagtcgttgggttttccttgttgcttaatttttaaaggtgtccagtgtgtaggtgcagctggtggagtcggtgggggagtcgttggtccgaggtccggttggggggtccctggacgtaccttctccgtggtcgccgtagtcccttgtaggtacttcccgtacctttacgtaagttacttttatcgtacttagtcgaccgtacggttccgggttacccgaccgtacggtccgttacccgggaagggggaacggtaccgttaagggtaaattacggttacgttctacggtaaggttaaacgtttaaggtaaaacgttaagtacggtaacgtaaaacgttaaacctaagtttaaacgtttaacgtttaacggttaaacgaaacccgtttaaaacgtttccggttaagggttaaacgggtaaacgggtactaaacgggtttaacctttaacccgaaaccgtttaaaccttaacccggtaacccggttaaacgggtaaaacccttaaaccgttaaacccggtaaaacggtaaaccctaaccggttaacgtttaacgtttaaccttaaccggttaaactaaacgggttaccgggaacgttaaccggtaccggttaaggaaccgtacggacgttaacgggacgggtaaacccgtacgggttacgttaagtttacgttaccgtttaacgggtacggtaaggggtaacggtaacggggtacggttaacgggttaaccgggttaacggggttaaccgggttacgggggtttaacgggttcccgggggtaaccggtaaccggggg

SEQ ID NO: 268561 - DNA, 806 bp, Homo sapiens
  misc_feature: GYAE6OF02H29Q1.28.57.F02.1.454.CMB.1.raw
  modified_base (179)..(179): a, c, t, g, unknown or other
  misc_feature (179)..(179): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagttttgggctgagcgtgggttttcctgttgctattttttaaaggtntccagtgtgaggtgcagctggtggagtcgtgggggagtcgttggtccagccgtggggggtccctggagactcgtcctggtgcagcctacgtggtacttctaccgttcaagttatttatacgtctagtgtacctacgtcgggtccacgacggtccgtaccggagggaacgggtacttaggaacttagttcgttacctacggtaacggtatttaaacggaagttaacgtgtaactaaagtaaactagttaacttaagttacgtacgaacttaaacgtacgttaggtaacggtaaaggacgtaaacgttacgttaccgaaaccccttaaccgttcggtaaacccggtaaacgggtaactaaaacccgtttaccgaaaacggttaacccgtaagtaccgttttaacggttaactttaccccgtttaaaagaaaccgggtcggtaaaccgtttaaccggccttaacggggtaagtacccgagggttaaccggaaacggtacccggtagttaccgtttagttaaacgttacgggttagtcggggtacgggtaaggaaggttaacccgggtaagttaagggtttaccggtaaagggtttccggggttaaggccggggtaaccggttaaccgggg

SEQ ID NO: 268562 - DNA, 785 bp, Homo sapiens
  misc_feature: GYAE6OF02IMGWU.28.57.F02.1.454.CMB.1.raw
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
tcagagtacgctatcacgaccggtgctcgatttagctcgatatagttgggtctgggagaggagcccccgccctgggtttcccagggtgttctcatttggtgatcagcactgcacacagaagagtcatgacggagtttgggctgagctggtttccttgttgctatttttaaagngtccagtgtgaggtgcagctggtggagtcgtgggggaggcttggtccagccgtggggggtccctggngactctccgtgtgcagtcctatggattccgaccttcaagttatttancggtctagtcgtctacgtcgggtcccncgacggtcctaccggaaggggaacgggacctaggaagttacgttcgtcgtacggtaaggttaagttaacggtaaagttaagtcggaacggtaaaattaaaccgtaattaactttaacgtttaactacgtaacctaaaccgtttcgttagggttaacggaacggggtaccctaaggtactttaacccgaaccctacgtttacgtaaccccggaggggttaaacctaaaccgtttaacccgaaacgtaaacccgtaccggttaccgtttacgttaaactttccgttaagtaaacggtacgggtaccgtaacggttccgtaaggtaacggtaacggtccggtaacggaacggggaaccgtaccggggtactttaagtacgtttaacggttccggtagggttacggggagtaagggacggtaacggttagttacgggtaccgttaggggtacggttcggggacccggtaacgggg

SEQ ID NO: 268563 - DNA, 645 bp, Homo sapiens
  misc_feature: GYAE6OF02HWCYQ.28.57.F02.1.454.CMB.1.raw
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccaggccgtgggggggtccctgagactctcctgtgcagcctctgattccaccttctagtatttangctatgcacgtcgggtccgccgacggcctaccgaggggaacgggacgtaggaacttagtgtctacgtaggtattagaagtaatggacgtaataactatatattacngtacaatctgtagagggcagatccacactctaccgaggaactaactcaaacgacaacgcttagtacttcttaacgaaagtcgggactacgtacgtagagtacgacgtcgaacggaaccgtacggtacgttacgttaacgtttacgtttacggtaagggttaacgggggaaggaacgggttaaccgggacggtttaagtaaggggtaaaccgggtttcgggggtttaggggttaccggggaccgggtaacggggg

SEQ ID NO: 268564 - DNA, 617 bp, Homo sapiens
  misc_feature: GYAE6OF02JC0OJ.28.57.F02.1.454.CMB.1.raw
  modified_base (432)..(432): a, c, t, g, unknown or other
  misc_feature (432)..(432): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcacgtgggtcccgccacggcctccgaaggggaagggactggaatatgtctcaggtattagaagtatgacgaataacataatatatgactaactctgtagaggcagacttccactatctacgaggtactaacttaccaagaaccncgtactgttacttactacgaaagtcgggactacgtccgtagacggagtcgtacgggaacggtaccgacggtagttacgttagttaacgttacggttgggtaacggggaggtaacgggtacggtaacggtaaggtttacggggaacgtttaggggggtttcggtacggggggtaccgtaacggggg

SEQ ID NO: 268565 - DNA, 611 bp, Homo sapiens
  misc_feature: GYAE6OF02FMKDE.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttggtccagccgtggggggtccctgagactctcctgtgcagcctctggattcacctttcagttatttatgcttatgcacgtgggtccgccagggctccgagggaagggacctggaatatgtctcaggttattagaagtaatgacgaataacatatattatgactaaactctgtagaaggcagattacaccatctaccagggactaacttccgaaagaaccacgtctattactcttacaaagtcgggacagacctgagacgtacgtaggacggaccgacggtcgtaggttattaacgtttacgtaggggtagggaaggtaacgggtaacggtacgggtaaaggtttcggggtaaaccgttagggggttttacgggaccggggggtccgtaacgggggg

SEQ ID NO: 268566 - DNA, 743 bp, Homo sapiens
  misc_feature: GYAE6OF02IYZS7.28.57.F02.1.454.CMB.1.raw
  modified_base (358)..(358): a, c, t, g, unknown or other
  misc_feature (358)..(358): n is a, c, g, or t
  modified_base (389)..(389): a, c, t, g, unknown or other
  misc_feature (389)..(389): n is a, c, g, or t
tcagagtacgctatcacgaccggtgctcgatttagctcgatatagttgggtcgtgggagaggagcccccgccctcgggtttcccaggtgttctcatttggtgatcagcactgcacacagaagagtcatgacggagtttgggctgagctgggttttccttgttgctattttaaaggtgtccagtgtgaggtgcagctggtggacgtcgtagggggtggtcttgggtccaggccgtggggggtccctagagtactcgtcctgtcgcagcctcgtggacttcaccgtttcagttatttactgtcgtacttgccgtactcgggtccgcccaggcctccgaagggaagggtactcggaaagtntggtacctcgtaaggtagttaagaagttaangtaccgaaattaacaatagtacttagtcactaaatcgtaacgtggaacggtcaagtactacctaaccgacttaccgtacgtaaacgggactaaacgttaccgtaaacgaccgaaacggtcttacgttacgttaacgttacgtaaacggttacgggcgtaacggtaccaggtaaccgtacgggtaacgttacgaacgggtaccgtacggtaccgttaagttaccgtaagtttacccgggttaagggtaaccggttaacggggacgggaaaggtttacggggaacggttttaacggggtaacccggttttaaggggggttaccggttacggggggtttacccggtaaaccgggggg

SEQ ID NO: 268567 - DNA, 695 bp, Homo sapiens
  misc_feature: GYAE6OF02G9JHX.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactccgtctgtgcagcctgtggattcaccttcagtatttatgctatgcacgtcgggtccgccaggcctccgaggggaacgggactagggaatagtgtctctaagggttattaagaagtaatggacgtaaataacattaatatttaatcgactaaacttcgtagtaggaagggctaaggtactttacccaactactcctacccgtaaggggactaacttacccgaaagaaccacggtcttgttaacttcttacaaaggttcgggacacggaccgtagacggtacgtcgtacgggaacggtacccgacgggtcttaggttaacgtttacgtttaaccggtggggttacggggaaggggtaacggggtaacgggtaaccggggttaaaggtttacgggggaaaccgggttttagggggggtttacggggtacggggggtaccccgggtaagggggg

SEQ ID NO: 268568 - DNA, 664 bp, Homo sapiens
  misc_feature: GYAE6OF02HHKIR.28.57.F02.1.454.CMB.1.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtgggggtccctgagactctcctgtncagcctctggattcaccttcgagtatttatgctatgcactggtccncaggctccgaagggaggactggaatngtctcgaggtatagaagtaatgacgaataacatataagttancgataaacctcgtgtaggaaggcaagtattaccaaccgtatacctaccgaagggtaactaaacgttaccgaaacgtaaaccgacggtccttagtaacttaccttaacgaaaagtgggacccagtaccccgtaggtaagaccggtctaggaaacggaccgaacgggtacttagggtaatttaacggttttacggagggtttacgggaagggttaaacggggacggtaacggggttaaggttttacgggaaaaccggtttacggggggttttacggtacgggggaccccgtaaacgggggg

SEQ ID NO: 268569 - DNA, 638 bp, Homo sapiens
  misc_feature: GYAE6OF02HPYFP.28.57.F02.1.454.CMB.1.raw
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (379)..(380): a, c, t, g, unknown or other
  misc_feature (379)..(380): n is a, c, g, or t
  modified_base (486)..(486): a, c, t, g, unknown or other
  misc_feature (486)..(486): n is a, c, g, or t
  modified_base (542)..(542): a, c, t, g, unknown or other
  misc_feature (542)..(542): n is a, c, g, or t
tcagagtacgctatcacgaccggtgctcgatttagctcgatatagttgggtctgggagaggagccccccgccctgggtttcccaggtgttatcatttggtgatcagcactgcacacagaagagtcatgacggagtttgggctgagcttgggttttccttgttgctatttttaaaggtgtccagtgtgaggtgcagctggtgagtcgtgggggagcttggtccagccgtggggggtccctggagactctcctgtgcagccctgtggacttcacctttcagttatttangcttangctacgtcgggtccnccgaggcctaccggagggaaggcctaggaatgtgtctacgaggtattaaggaatatganaatacatatatnnactatctgagagcagtatccgacatcgacgaaggactaacgttaccaaagtaaccacgtacttacgtacttaccttaagtaagtcgggtactacggtccagggtanacggtcggttagaaccgggtacgtaccggtacgttagttacgtaattttaccgggnggggttaaggggaacggtaggggaaccggttaagggttaacgggtttaagggtaaaccggtttgggggttcggggtagggggtaccgtaacggggg

SEQ ID NO: 268570 - DNA, 785 bp, Homo sapiens
  misc_feature: GYAE6OF02IYS3R.28.57.F02.1.454.CMB.1.raw
  modified_base (348)..(348): a, c, t, g, unknown or other
  misc_feature (348)..(348): n is a, c, g, or t
tcagagtacgctatcacgaccggtgctcgatttagctcgatatagttgggtctggggagaggagcccccgccctgggtttcccaggtgttctcatttggtgatcagcactgcacacagaagagtcatgacggagtttgggctgagtctgggttttccttgttgcttattttttaaaggtgtccagtgtagaggtgcagctggtggagtcgtggggggaggcttgggtccgaggtcccgtcggggggggttccctggacgtaccgttccttccgtggtgccacggcctcgtggatttcctacctttcgagtttaactttaatgtctatcgtctaccggtcggggtcccncccggaacgggtcctacccgggaagggggtaacggggaccgttaggggaacttaggttcggtacttcgtaagggttaagttaagtaaagttaagtcgtaacgtaaataaactagttaattacttatagactaaactcgtaggtaggaacgggtacagtaacgttccaacctagttaccgtacccggtaaggaaacccttaaacgttaaaccccgaaaacggtaaaccctaacccggttattaaccggtttacctttaaccgttaaacgtaaaccggtcggggtaaccacgtaacccgttaggaaacgtacgtagtacggaaacggtcggtaacgtatacgtatttcggttacgtgggaagggtacgaagggtaccggttaagggtaacggtttagggtaacggttggggggtacggtacgggggtacgtaaccgggg

SEQ ID NO: 268571 - DNA, 748 bp, Homo sapiens
  misc_feature: GYAE6OF02I2A4V.28.57.F02.1.454.CMB.1.raw
  modified_base (308)..(308): a, c, t, g, unknown or other
  misc_feature (308)..(308): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtcagtgtgaggtgcagcgtgggtggagtcggtggggggacggtcgttcggtccgaggtccggtcgggggggttccctggacgtaccttccttccgtggtcgcaggccctcgtaggtacttctaccctttnagtttattttatgtctatgacctacgtcgggttcccgccgtaggccgttaccggaggggaacgggacgtaggtaatagtgtccgtacgtaggttattaaggaagtaagtggaacgtaaataaacgtattaatttaagttaactagtaacctaaaccgtcgttaggtaaggacggggtaactagtacttaacccgactaaccttcgtaacccgaaagggtaacctaaacgttaccaaaacggaacctaccgtacgttacgttaacttcttaaacgaacgttcgggactacgtccgtaggtacgacgggtcgtacggaacggtaccgacgttacgttacgttacgtttacgttacggttgggtacgggtaaggaacgggaggttacggtaaggtttacgggtaacggtttacggggttagggtacggggtaccggtaagggg

SEQ ID NO: 268572 - DNA, 682 bp, Homo sapiens
  misc_feature: GYAE6OF02I1Z68.28.57.F02.1.454.CMB.1.raw
  modified_base (399)..(399): a, c, t, g, unknown or other
  misc_feature (399)..(399): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctaatttttaaggtgtccagtgtgaggtgcagctggtggagtcgtgggggagtcttggtccagccgtggggggtccctggagactctcctgtgcagtcctcgtggtacttccgtaccttcgagttatttatcgtcttagtgtcgtacgtcgggtcccgccgtacggcctccggaaggggaacggtacgtaggaatgtgtctagaaggttatagaagtatagacaatacgatatattanagactaacgtcgttaggaggaacgggtatacgtacttacccaacctacgttaccctaccggtaagggtaacctaaaccgttacccaaacggtaacctaacggtacttagttacttaccgttaaccgtaacgttgggacctacggtaccgtaggaacggtcgtagtaacggaacggtaccgtagtacgttagtaattacgttacggtggtaagggacgtaaggggacgtaacggtaaggttacggtaacggttaggggtacgggttacgggacggtaaccgggg

SEQ ID NO: 268573 - DNA, 713 bp, Homo sapiens
  misc_feature: GYAE6OF02G2IDL.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtcccttagactctcctgtgcagcctcgtggattccacctttcagttatttatgctatgcacgtgggtcccgccaggcctccgaggggaagggactggaatgtgtctcgaggtattaaggaagtaatgacgtaaataacattaatattatgactaaactctaggtagaagggtcaagtacttaccgaacctacttacccgtacgtaacggggaactaaactttacccgaaaagaaacccacggtacttacgttaattaccctttaacgaaaacgttcgggacctacggtacccgtaggaacgaggtaccgtagggaacgggaacccgtacgggtaccttaggttaaactttacgtttaaccgtaggggttaggggaaacggtaaggggtaacgggaacgggtttaagttaaccggggtaaacgggttttagggggtttacggggttaccggggggtacccggtaagggggtaaccccggg

SEQ ID NO: 268574 - DNA, 716 bp, Homo sapiens
  misc_feature: GYAE6OF02HNQ6K.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctcgtggattccaccttcagttatttatgctatcgctacgtcgggtcccgcgacggcctaccggaaggggaacgggaccttagggaattagtcgttaccttcgaagggttaatttaaggaaagttaagtacggacgtaaataaactattaattaatttaatagtaacctaaaacttcgtaggttaggaaaacggggtctaaggtaacttacccaaccgtaacgttccctaccggaacgggtaaacctaaaccgttaccgaaacgtaaaccgaccgtacgttacgtaacttacttaacgtaaagtcgggacacggtacctaggacgacgtacgtacggaacggaccgtacgggtcttaggttacttacgtttacggtagggtagggaagggtaagggttagggttaaggttacggttagggtaacggttaggggttacgggtcgggggacggtaacgggg

SEQ ID NO: 268575 - DNA, 690 bp, Homo sapiens
  misc_feature: GYAE6OF02IX834.28.57.F02.1.454.CMB.1.raw
  modified_base (172)..(172): a, c, t, g, unknown or other
  misc_feature (172)..(172): n is a, c, g, or t
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctattttaaggntccagtgtgaggtgcagctggtggagtcgtggggggagcttggcctagccgtggggggtccctgagactctacctgtcncagcctctggtacttcctaccttcagttactttagtgtactatgctaaccgtcgggtacccgaccgacgggtctacccgggaagggggtaacgggaccttagggtaaactnttacggtcctagtaggttaataaaggtaagtaacgtgaaccgtaaataaacgtataactttaatacgtctaaacctaaacgttcgtaggtaacgggaagggtactaagtaacttacaaccggtactccgtacgaaggtaactaacttacaaagaccacgtacttacgtactacctttaaagaacgtgggtaaccaggtacccgtaggaacgtgacgtacgggaagacccggagtacgttgtaacttaggttacgtagggtacgggaagtacggtaacgggtaggtaactaaggggtaacgttcggggtaggtccgggaagtaccgggg

SEQ ID NO: 268576 - DNA, 920 bp, Homo sapiens
  misc_feature: GYAE6OF02IPIWF.28.57.F02.1.454.CMB.1.raw
  modified_base (319)..(319): a, c, t, g, unknown or other
  misc_feature (319)..(319): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggtagtttgggctgagcgttgggttttccttggttgtcttaagtttttaaaggtcgtccagtgtgaggtgcagcgtggtggagtcggtgggggaggtcgttggtccaggtccggtcggggggtccctaggacgtccgtccttccgtggtcgacctacggtcccttcgtggtaactttcctacccgttanaggtttaatttacgtcgtctagtccgtacgtaccggttcggggtcccaccggtacggtaccgtaccgggaaggggtaacggtacgttaacggggtaaattcggttacggttacccgttaggtaaacgggttttaaacgtaaacgggttaaaaagttaacgtaacggtaaccgtaaaaacttaaattacgttaaaacgttttaaggttaaaccgttaacgtaaacccgttaaaaacgtttccggttaaaggggtaacggtaacgggttaacctaaaggttacgttaaccctaacctaacgttcccgaaacgggtaacggttaaaccttaaaccgtaaacccgaaaggtaaacctaccgtacgttaacgtttaactaccgtaaacgtacggttaacgggacctacgtaccggttaaggacgtaaacggtcggttaacggaacgggtaaacccgtacggtaacgtttgttaaagttccgggtaaggttaccggggagggtaacggtaaacgggggttacgggtaacggtttaaacgggttaccgggttaaacgggggtttaagggttccgggggtttaacccgggacgggttaaaccccggggg

SEQ ID NO: 268577 - DNA, 677 bp, Homo sapiens
  misc_feature: GYAE6OF02ILUWR.28.57.F02.1.454.CMB.1.raw
  modified_base (535)..(535): a, c, t, g, unknown or other
  misc_feature (535)..(535): n is a, c, g, or t
  modified_base (547)..(547): a, c, t, g, unknown or other
  misc_feature (547)..(547): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagcttgggttttccttgttgcttatttttaaaggtgtccagtgtgaggtgcagctggtggagtcgtggggggaggcttggtccagccgtggggggtccctgagactctcctgtgcagcctctggattcctaccttcaagttattttagcgtctatcgtactacggtcgggtcccgccgacggtaccgtaccggaagggggaacgggactagggaattagtcgtactacgttaagggtaacgtttaaggaaacgttaatcggaacgtaaataaacgtaattaattaattacgtacgaacctaaaacttcgtaggtaggaagggtcaagtactacaacctctaccgacgaaggaaactacttaccaaagtaaccacgttctagttacttactanaaacgtggaacncgtacgagacgagtcagaacggacgtaacggcttaagttagtacgttacggtggagggaacgtagggaacggtacggttaaggtaacgggttaaggttacggggttacggggtcgggaaccggtacgggg

SEQ ID NO: 268578 - DNA, 732 bp, Homo sapiens
  misc_feature: GYAE6OF02I03VV.28.57.F02.1.454.CMB.1.raw
  modified_base (256)..(256): a, c, t, g, unknown or other
  misc_feature (256)..(256): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggttttccttgttgctattttaaaggtgtccagtgtgaggtgcagctggtggagtcgtgggggagtcgttggtccgagccggtgggggtccctggagactctctgtgcngtcctcgtggtacttcgaccttcgagttatttagtgtctatcgctacgtcgggtcccgaccgacggtccgtaccggaaggggaacggtacgtacggaattacgttcggttccgtacgtaaggtttaagtaacggtaaaagttaagtacggaacgttaaaactaaacgtaattaagttaagtttaactcgtaaactaaaacgtttcgttaaggtacggtaaacgggtaccgtaagttaacgttacccgtaacctaacgttccgaccggtaacggtaactaaaccgttacgaaacgacgtacgtacgtacgttaacttaccgtaacgtaaagtccgggtaacgacgtaacgtagacgtacgacggttacgaacgacgtaccggtagttgtaactagtttaccgggttggaggttacggaacgtcggtaacggtacgttagggtaacggttgggtttacgggcgggtacgtaaccgggg

SEQ ID NO: 268579 - DNA, 702 bp, Homo sapiens
  misc_feature: GYAE6OF02JEQQ8.28.57.F02.1.454.CMB.1.raw
  modified_base (307)..(307): a, c, t, g, unknown or other
  misc_feature (307)..(307): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtggggggaggtcttgggtccaggccgtggggggtccctgagactctcctgtgcagcctcgtggacttcaccttcagttatttatgctatgcacgtgggtccnccgaggctccgagggagggactggaatagtgtctcgaggttattaaggaagtaagtgacgtaataacataattattaagtgaactaaactcgttagtaggaacgggactaaggtacgtttacaacctattacccgtacgtaacgggtaactaacgttaccaaacgaaccaacggttcttacggttacttaccgttaaacgtaaagtcgggaactacggtacccgttaggacggtaggtaccgtagggaacggaaccgtaacgggtacgttaacgttagttaaccgtttaaggtcgggttaagggaacggggtaaagggtaacgggtacggtaacggtttaacgggtaacggtttaacgggggtttcggggtaccgggggaccggtaaccgggggg

SEQ ID NO: 268580 - DNA, 709 bp, Homo sapiens
  misc_feature: GYAE6OF02FPY9Z.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgcttatttttaaaggtgtccagtgtgaggtgcagctggtggagtcgtggggggaggcttggtccaggccgtggggggtccctggagactctcctgtgcacgcctctggacttccaccttcagttattatgctatgcacgttcgggtcccgccgaggtcctccggaagggggaaggacgtgggaaatagtcgtctcgtaagggttattaacggaagtaagtgtacgaaataacattatattatagactaactctaggtagaacgggacaggtactttaccgaacctagtccgtacccgaagggaaccttaaacgttacccgaaagaacctaccggttctaagtttaccttacgttaacgtaaagtcggggtaacacggtcctagggagtaacggtcgtaagggaccggtaacgtcccgggttaataggtttacttaacggttacggtttagggggtaggggaacgggaagggtaaccggtagggtaaaggttttaccggggaaacgggtttcggggggttcgggttaacgggggacccggtaacggggg

SEQ ID NO: 268581 - DNA, 870 bp, Homo sapiens
  misc_feature: GYAE6OF02H2PA8.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttaaaggtgtccagtgtgaggtgcagctgggtggagtcgtgggggaggcgttggtccagtccgtggggggtccctggagactctcctgtgcagtcctcgtggtattccgtaccttcagttatttatgacttatgctacgtcgggtcccgccgaggtcctaccggaagggaacgggtactaggtaatagttgtccgtacgtaaggttagttaaggaaagttaagtacgtaacgtaaaagttaaactaagttaatttaagtttaacgtaacgtaacctaaaacgttccgttagggttaaggaacggggtactaacggttaacttacccgaaacccgtaacgttacccggtaacccggaaacggggtaaacctaaacgttaaaccccgaaaacgaaaaccgtaacccgtacgtttaacgtaaacctttaccgttaaacgaaaaggttaccgggggtaaccaaccgggttacccgtaaggtaaaccgggtacggttaaccggtaaacgggtaacccgggaaacggtaacccgggttaccgtttaaggttaaacgttttaaccggttttaacgggtcggggttaaagggggaacggtaaacggggtaacgggttaacggggttaaacggtttaacggggttaaaccggggttttaacgggggggttttaacggggtacccggggggtaaccggtaacccgggggggg

SEQ ID NO: 268582 - DNA, 556 bp, Homo sapiens
  misc_feature: GYAE6OF02H5Z1L.28.57.F02.1.454.CMB.1.raw
  modified_base (300)..(300): a, c, t, g, unknown or other
  misc_feature (300)..(300): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctgggggaggcttgggtccagccgtggggggtccctggagactctcctgtgcagcctctggattcaccttcagtatttatgctatgcactgggtccnccaggctccgagggaaggctggaatatgtctcgaggtatagaagtatgacgaataacatatatatgactaaactctgtaggaagggcagtactcacatctacaggactattaccaagaccacgtctagtacttcttacaaagtgggacacgtaccgtgaggacgcgtagaggacgacgacttgtatattacgtggtgggaggtaaggaggacggtagttagggtaacgttaggggtcggtacggggcgtaacgggg

SEQ ID NO: 268583 - DNA, 752 bp, Homo sapiens
  misc_feature: GYAE6OF02FHB5T.28.57.F02.1.454.CMB.1.raw
  modified_base (237)..(237): a, c, t, g, unknown or other
  misc_feature (237)..(237): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgtgcttatttttaaaggtgtccagtgtgaggtgcagcgtggtggagtcgtgggggagcttggccagccgtgggggtcccngagactctccgtgtgcacgcctcgtggacttccacctttcacgttatttactgcttatgcctaccgtcgggtcccgccgacggtcctccgaaggggtaacggaccgtagggtaattaagtcgttactaccgaagggttagttaaggaaagttaagttcggaaccgtaaacttaacgtaacttaatttaagttaactcggaacctaaaaccgtttccttagggacggtaaaggggctaaggtactttaccaacccgtcttaccgtacccggtaagggaacctaaacgttacccgaaaacggaaacccgtaccgtacgttagttaaccttaccgttaaccgtaaagttccgggtaacaccggtaccgtaggaacgtacgcgttaacgggaacgtacccggacggttcgttacgttactacgtttacgtaggggtagggaaggtaacggggtgtaacgggttaacggttagggtaaacccgggtttaggggttcgggtaccggggacgtaaccggggg

SEQ ID NO: 268584 - DNA, 813 bp, Homo sapiens
  misc_feature: GYAE6OF02JUY1S.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacgggagtttgggctgagctgggttttccttgttgctatttttaaggtgtccagtgtgaggtgcagctggtggagtcgtgggggagcgttggtccagccgtggggggtccctggagtactcgtcctgtgcacgcctcgtggacttccaccttcagttatttagtgctatgctacgtcggtcccgccgaggtcctcgaggggaacgggactaggaagtagtgtaccgtacgtagttaagtaagtaagtaacgtggacgtaaataacgtattaataacgttatacgaactaacgttcttaggtacggaaacgggtactaagttacttacccgaacctaacttccggaccggaaaggtaaaccttaaacgtacccgaaaggtaaccctacgggacctttaaggttacctttaaccgaaacttaaacgggtcgggtaaaccttacggggacccctaagggtaacgtaccggttcccgggtaaagggaaccccgggggtttacccgtaacccgggttaacgtttaacggtttaacccgttttaaacggtttaacgggtaggggggttaacccggggtaagggggtaaccggggtaacgggttaaacggggtttaacgtttaaaccgggggttaagggggttttaaccggggggtttacggggggaccccgggttacgggggaaaccggggg

SEQ ID NO: 268585 - DNA, 636 bp, Homo sapiens
  misc_feature: GYAE6OF02GKRGR.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttttaaaggtgtccagtgtgaggtgcagctggtggagtcgtgggggaggcgttggtccagcccgtggggggtccctggagactctcctgtgcagcctctggattcaccttcagtatttatgctatgcactggtccgccaggctccgagggaaggacgtggaatatgtctcgaggtattagaagtaatgacgaataacatataattatagactaaactctaggtaggaacgggacagtacttacaaccgtatccttacccgaacgggtaacctaaacgttacccaaacggaacctaacgtaccttacggttacttacccgtttaacgaaaagtcggggactacggacccgttagacggtagccgttagggaacggacgacgtccgtagttattacttaggttggtagggaaggtaagggagtacggaagttaggtaccggttagggtttcgggtacggggacggtacgggg

SEQ ID NO: 268586 - DNA, 795 bp, Homo sapiens
  misc_feature: GYAE6OF02FLX34.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtggggggaggcttggtccaggcccgttgggggggtcccctgagacctcctcctgtgccacgcctcgtggtattccaccttcagttatttatgctatgctacgtcgggtcccgccgacgggcctccggaaggggaacgggacgtaggaaattagtcgttacctacgtaaggtttaattaaggtaaagttaaagtcggaacgtaaacttaaacgtaattaattaagtttatacgaactaaacgttctagggtaggaaggggactaaggtactttaccgaacctaacttcccgtaccggaacgggtaacctaaacgttaacccgaaacggaaacccgtaaccggttacgtttacgttaactttaccgttaaaccgtaaacggttacggggacctaacgggtacccgtagggaacgtcggtaccgtagggaaaccggtaccggaaccgggttgttacgtttaacgttaacgtttaaccgggttggggttacgggaaacgggtaaggggtaacgggaacgggtttaaaggttaccggggttaaacgggtttacggggggttacggggttaccggggggtaccggtaacgggggg

SEQ ID NO: 268587 - DNA, 989 bp, Homo sapiens
  misc_feature: GYAE6OF02H8R4R.28.57.F02.1.454.CMB.1.raw
tcagagtacgctatcacgaccggtgctcgatttagctcgatatagttgggtctgggagaggagccccccgcccctgggtttcccaggtgttctcattttgggtgattgacgacacgtcgaccaacaacgaaggaaaggtacgtactaggtacgggaagggtttaggggtttttcggggccgttagggcggttccgggttttttccggggtttttcctttggtttcgttactttttaaaaggttttttaaagggtccgtacgttagggttggtagggtagggtacgcgagtcgggttggggtagggtgggttcggggtaggggggacgttccggttcggtacgaccgggtcggggtccgggggtcccgtaggacgtaccttccgtccgtggtacgaccgtacggtccctacggttacggttaccttaaccccgttacttacgttaaagtttatttacgtgtaacttagcgtaccgtacgggttcccgaccgccggtaacggtccgtaaccgggaaggggaacgtacgtaaggtaattagtacgtaccgtaaggttaagttaaacgtagaaagttaacgaacgaacttaaaataagtaactaattaatacgtaaacgtaacttaacgtcgttagggaacggtaacgtacgtaacgttaacgaaccctaccgtaccgtaactaaaccggggtaaaacgtaaacttaaaccccggtaaaacctaaaggtaacccgttaaccgtaacgtttaaccttaaacgttaaccttaaagggaacggtaaacgcgggttaacctaaggtgaacggtcggtaacgtaaacgggaccggttaaaccggacgggtttaacgttacttaaacggttaacggttagggggacgggttaaaagggtcggggaaacgggttacggttaaaggtttaacgggttaacggggttaaaccgggtttggggggttacgggttaaccccgggggacggtttaaacccggggg

SEQ ID NO: 268588 - DNA, 700 bp, Homo sapiens
  misc_feature: GYAE6OF02GA9JC.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcaatgacggagtttgggctgagctgggttttccttgttgctatttttaaaggtgtccagtgtgaggtgcagctggtggagtcgtgggggaggcttggtccaggccgtggggggtccctggagactctcctgtgcacgcctctggtacttccaccttcagttatttatcgctagtcgcacgttcgggcccgaccgacgggctaccggaaggggtaacgggacctagggtaatagttcgtacttacgtaaggttaagtaaggtaaagttaacgtcggaacgtaaacttaaacaatttaattaacgttatacggtaacctaaaaccgttcgttaaggacggaaacggggtcaagtacgttaccactaactccgaccgagggaacctaacgtaccgaaacgaaccgacgtactaggttacttacgttaacaacgtacgggacgtaccgacgtagacgagtacgtaggaacggacgtacggattaggttacttaacttacggtgggtagggtacgaagggtacggtacggttaaggttacgggtaaacgggttggggttcgggtacggggcggtaacggggg

SEQ ID NO: 268589 - DNA, 813 bp, Homo sapiens
  misc_feature: GYAE6OF02HUKCH.28.57.F02.1.454.CMB.1.raw
  modified_base (249)..(249): a, c, t, g, unknown or other
  misc_feature (249)..(249): n is a, c, g, or t
  modified_base (316)..(316): a, c, t, g, unknown or other
  misc_feature (316)..(316): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgttgggttttccttgttgcttaatttttaaaggtgtccagtgtggaggtgcagcgtggtggagtcgtgggggagtcgttggtccagccgtggggggtccctggngactctccgtgtgcacgcctgtggacttcaccttcagttatttatgctatgactacgtcgggtcccncgtacggcctccgggaagggggtaacgggtacgttagggaaactttagtcggtttacctaccggtaagggtttaagttaaaggtaaaggtttaactacgggaaccgtaaaattaaccgtaatttaaatttagttaacgtacggtaacctaaaaccgttgtaggtacggaaggggtctaacggtacttacccaaccgtaactttcccgtaccggtaaacgggtaaccttaaaccgttaaccgaaaccggtaaaccctaccggttaaccgtttacgttaaaccgttccgtttaaaacgtaaacggttccggggacttacggttacccggtaggaaccggtactacgggtacggaaccggtaccgaacgggttcgttaaggttacgttttagttaaccgggtgggttaaacgggcgggtaacgggttaacggtaacggtttacgggttagggtaacggtttagggggtttccgggtaccggggtaccggtaaccgggggg

SEQ ID NO: 268590 - DNA, 712 bp, Homo sapiens
  misc_feature: GYAE6OF02GAWC1.28.57.F02.1.454.CMB.1.raw
  modified_base (296)..(296): a, c, t, g, unknown or other
  misc_feature (296)..(296): n is a, c, g, or t
  modified_base (606)..(606): a, c, t, g, unknown or other
  misc_feature (606)..(606): n is a, c, g, or t
  modified_base (628)..(628): a, c, t, g, unknown or other
  misc_feature (628)..(628): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtcgtgggggaggcttggtccagccgtgggggtccctggacgactctctgtcgcacgcctcgtggtacttcctacctttacagttactttatcgtnttatgtccgtacgttcggggtacccgccgtacggccttaccggaagggggagggtaacgtaggaatacgttgttcctacgtaagggttaagttaaggtaaaggtaactcggaacgtaaacttaaacaagttaatttaatttaacgtacgtaaaccgttaaactcgttaggtacggaaacgggtactaacggttaacttaccgacctaacttcccgtaaccgacggtaaactaaccgtaccgaaaaggaaccctcggtaactgtttacctaaccttagaaacgtttcgggaccgtagtccgtaggaacggntacgtagggaaccacggacgtnttagtagtactttcgggagggtacggaggtacggacgtaggtacgttaacgggtaggttggggtacggtggggaccgtacgggg

SEQ ID NO: 268591 - DNA, 581 bp, Homo sapiens
  misc_feature: GYAE6OF02HRH1Q.28.57.F02.1.454.CMB.1.raw
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggaggcgttggtccagccgtggggggtccctgagactctcctgtgcagcctcgtggattcaccttcagttatttatgctatgcacgtcgggtcccgcacgggcctccggaagggaagggactaggaatatcgtctcgaggtattagaagtatgacaataacatatattangacaactcgtagtaggaaggnagtatcactagtacacgaggaacaacttaccgaaagaacacgtctagttacttcttaactaagtcgggacacgacctagagcgacgtaggaggacgacgtctagtacttatacggtggtagggaggtaggaggacggtaagttaggtacgttaaggggtcgggtacgggacggtaacggg

SEQ ID NO: 268592 - DNA, 698 bp, Homo sapiens
  misc_feature: GYAE6OF02HMUCG.28.57.F02.1.454.CMB.1.raw
  modified_base (175)..(175): a, c, t, g, unknown or other
  misc_feature (175)..(175): n is a, c, g, or t
  modified_base (259)..(259): a, c, t, g, unknown or other
  misc_feature (259)..(259): n is a, c, g, or t
  modified_base (402)..(402): a, c, t, g, unknown or other
  misc_feature (402)..(402): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggngtccagtgtgaggtgcagctggtggagtcgtgggggagcttggtccagccgtggggggtccctgagactctcctgtgcagcctntggacttccaccttcagttatttatgctatgcctacgtggggtcccaccgagggtcctaccggaaggggaacgggactagggaattagtcgtctacgaggttaacttaagaagtaatggacgtaaataacattaattatttanacgaactaaaattctggtaggaacgggactaagtatacccacattaccgtacgaacggtaaactaacgttaccgaaaagaaccacgtcgttagttacttctaaacgaagtcggacacgccgtaggaagtacggtataacgggacggtaaaccgtacgggtaccttagttaacgttaacggtttaaccgttagggggacgggtaaacggggtaaggtaccggggtaaacgggttagttaaccgggggtaacgtttacggggggttacggggttacccggggaccggtaaacgggggg

SEQ ID NO: 268593 - DNA, 672 bp, Homo sapiens
  misc_feature: GYAE6OF02G7NDU.28.57.F02.1.454.CMB.1.raw
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtctgggggaggcttggtccagccgtggggggtccctgagactctcctgtgcagcctctggattccaccttcagttatttatgctatgcacgtcgggtcccgccgaggcctccgaggggaagggactaggaatagtgtctctaggtataagaagtaatgagaataanatatattatgactaaactntagtgaagggcagtattacactatcctaccgagggaacctaaacttaccgaaaagaacctaaccgacgtttacgtaactttacctaacgtaaaagttcggggaaacccacggttaaccctagggaaacggtacggtacgttaacgggaacgggtaaacctaccggggtaccttaggttaagttaaccttttaaggtgggttaacggggaggaagggtaacgggtaacgggtaagtttaacgggaacggtttaggggtttacgggtacgggggtaccgtaacggggg

SEQ ID NO: 268594 - DNA, 608 bp, Homo sapiens
  misc_feature: GYAE6OF02FS8AI.28.57.F02.1.454.CMB.1.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagagtacgctatcacgaccggtgctcgatttagctcgatatagttggggtctgggagaggagcccccgccctgggtttcccaggtgttctcatttggtgatcagcactgcacacagaagagtcatgacggagtttgggctgagctgggttttccttgttgctatttttaaggtgtccagtgtgaggtgcagctggtggagtcgtgggggagcgttggtccagccgtggggggtccctgagactctcctgtgcagcctctggattcaccttnagtatttatgctatgcacgtgggtccncaggcctcgagggaacggacgtggaatagtgtctcgaggtatagaagtatgacaatacatatattangacaactntagtgaaggcagtatcacatctacgagggactaataccgaaacgacgacgtactgttaactacctacaaagtcgggactaggtaccgtggaacgtacgtacgtaggaacggaccgtacgggtacttagttacgttaagttaccggttagggtacgggaaggtacgggtacgtacgggtaacgttacgggtaaccggttacggggtcgggttacgggtacccggtaacccgggg

SEQ ID NO: 268595 - DNA, 803 bp, Homo sapiens
  misc_feature: GYAE6OF02HSHRN.28.57.F02.1.454.CMB.1.raw
  modified_base (286)..(286): a, c, t, g, unknown or other
  misc_feature (286)..(286): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtgggggagcgttggtccagccgtggggggtccctgagactctcctgtgcagcctctggacttcaccgttcagtattttangtcttatgcacgtgggtcccgcaggcctaccgaaggggaagggacctagggaactagtgtcctagaaggttattagaaacgtaatcgaacggtaaacttaaacgattaattaatttaagtacgtaacctaaaactttccggtaaggttacggaaaacgggggtacctaaagtacgtttaccgaaaccctaacgttacccgtacccggtaacggggtaaaaccttaaaccgttaaaccggaaaaccgtaaaaccgaacccggtacggttttaaataccggtttaaccctttaacgtaaaaacgggtccggggtaacctaacgggtacccgttaagggaaccgttaaggtccggttaaagggaaccggtaaacggacgggttaccgttaagttacgtttaacggtttaccgaaggggtttacggggaaaggtaaggggaacggtagggttaaacgggtttcgggtaaaacgggttttcggggggttttaacggacggggggtacccgttaacccggggg

SEQ ID NO: 268596 - DNA, 728 bp, Homo sapiens
  misc_feature: GYAE6OF02FPB8R.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaaggtgtccagtgtgaggtgcagctggtggagtctgggggaggcttggtccagcctggggggtccctgagactctcctgtgcagcctctggattccaccttcagtatttatgctatgcacgtgggtccgccgaggctccgaggggaacggactggaatagtgtctcgaggtattagaagtaatgacgaataacataatattatgactaaactctaggtaggaaaggggtcaagtaacgtttacaaccctacttaccgttacccgaaggggtaacctaaaccgtttaacccgaaaacggtaaaaccaaccggtccgtttaacggttaaccgtttaccgtttaaccgtaaaaacggtttcgggggaccctaagggaccccgttagggaacggacggtcccggtaaggaacggggtaaacccaacgggtccgttaggtttacgtaagttttacccggtgggtacgggggaacgggaagggttagggacggggttaacgtttacgggggtaaacccgggtttagggggtttaccgggggtacggggggacccgtaacgggggg

SEQ ID NO: 268597 - DNA, 857 bp, Homo sapiens
  misc_feature: GYAE6OF02GACB6.28.57.F02.1.454.CMB.1.raw
tcagagtacgctatcacgaccggtgctcgatttagctcgatatagttgggtcgtgggagaggagcccccgcccctgggtttcccaggtgttctcatttggtgatcagcactgcacacagaagagtcatgacgggagtttggggctgagcgtgggtttttccttgttgctatttttaaaggtgtccagtgtgaggtgcagctggtggagtcgtgggggagcgttggtccaggccgtggggggtccctgaggactctcgtgtgcacgccttcgtggattccgaccttcagttatttattgcttatcggcacggttcgggtacccgaccgtacgggccttaccgggaaggggaacgggtactagggtaaacttcgttagttccgtcgtaaggtttaaggtaagtaaggttaaagtccggtaagtaaagttaaaactattaacgtttaaagtttaactaacggtaacctaaaaccgttacgtttaacgggtaaggggtaaacgggtacctaaggtaactttaacccgtaacccgtaaacgttccccggttaaccccggttaaacggggaaaccttaaacccgtttaaaccgaaaacccggtaaaaccgtaacccgggttaacttaccggtttaaacgtttacccttaacgttaaaccggtaccgggttaccgaaccggtacccgtttacggaaccgttaacggccgttaagggaaccgaaacggtaaccggttccgttaagtttaccgttacgttaaccggtttggggaaccggttaagggtaacgggtaacgggtacggtttaaggttacggtaaccggggtttagggggttacggttacggggggaccgtaaccggggg

SEQ ID NO: 268598 - DNA, 649 bp, Homo sapiens
  misc_feature: GYAE6OF02FXX57.28.57.F02.1.454.CMB.1.raw
  modified_base (399)..(399): a, c, t, g, unknown or other
  misc_feature (399)..(399): n is a, c, g, or t
  modified_base (417)..(417): a, c, t, g, unknown or other
  misc_feature (417)..(417): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctgggtggagtcgtggggggaggcgtttggtccaggcccgtgggggggtcccctggagactctcctgtgcagcctctggattcaccttcagttatttatgtctatgcacgttcgggtcccgccgaggcctccgaggggaacgggacgtgggaaattatggttctcgtagggttattaggaaagtaatgacgaataacatatatatnactaactctgtagagggnagattcaccatctccgaaggactaacgttaccaagaacctacggctacggttaatcttaacgaactcgggactacggacctagacggaaggcgtagggaacggacgtaccggcgttagttagtaacggtttaccgttaggggtacggggtaaggaacgggaacggtaggggtaacggtttacgggtaaacggtttagggggtttacgggtacggggtaccggtaaccggggg

SEQ ID NO: 268599 - DNA, 902 bp, Homo sapiens
  misc_feature: GYAE6OF02I019P.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggtttttccttgttgcttaagtttttaaaggtgtcctagtgtgaggtgcgagctggtggagttcggtgggggaggtcgttcggtccaggtcccgtcgggggggtacccctggacgtaccgttccgttcccgtggtacgccaccgtcccgttcgtggtaacttccgtaccctttacgtaaggtttattttaagtcgtacttactcgaccgtaccggttcggggtcccgtccgaccgggtacccgtacccggaaggggaaacggggttcctaagggtaacttagttacggtccgttacgtaaaggttaacgttaaaggtaaaacggttaacgtacggtaaacggtaaaacttaaaaccgtattaaactttaaacgttaagtcgaaaaccctttaaacgttccgttaagggttaaccggggtaaagggtacccgttaaagttaaccctttaacgaaaccccgttaacttaccccggtaaaccggtaaacccgggttaaaaccttaaacccggttaaacccgaaacggtaaaacccgtaccgttacgtaacgtttacttaaccgttaaaaccgtaacggtaccgggtaacctaaccggtacgttagggaaacgtacggtacgtaacggaacgggtacccgtaacgggttgtaaccggttactttacggttacggtaggggtaagggaggtaaagggacggttaacggtaacggttaaggtaaccggttaggggtccgggttaagggccgtaacgggg

SEQ ID NO: 268600 - DNA, 713 bp, Homo sapiens
  misc_feature: GYAE6OF02IK99E.28.57.F02.1.454.CMB.1.raw
  modified_base (442)..(442): a, c, t, g, unknown or other
  misc_feature (442)..(442): n is a, c, g, or t
tcagagtacgctatcacgaccggtgctcgatttagctcgatatagttgggtctgggagaggagccccccgccctgggtttccccaggtgttctcatttggtgatcagcactgcacacagaagagtcatgacggtagttttgggctgagtcgttgggtttttccttgttgcttaattttttaaaggtgtccagttgtgaggtgcagcgtggtggagtcgtgggggagtcgttggtccagccggtcggggggtccctggacgactctccgtgtcgcacgcctcgtggtacttcctaccttcagtttaacttttatgtacttagttcgactacggttcggggttcccgacccgacggtccgtaccgggaagggggaacggtacgtaggtaatagttgtcctagtaagttataagtaatagtgacgtaaataacattaatagttanacgtaacaacttcgtaggtacggaacggtactaagtacgttacccaacctacgttacccgtaaccggtaacggaaccttaaacgtaccgaaaacgtaccgacgttacgttattactacgttacgtaacggtaggtacacggtacgagtaggacgtacgtacggaacgacgtaccgtattagttattacggtacggtagggttaacggacggtaggacggttaagaccggtttaagggtacggttaggggtacggtacggggacgtaccggg

SEQ ID NO: 268601 - DNA, 662 bp, Homo sapiens
  misc_feature: GYAE6OF02H23YC.28.57.F02.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcttggtccagccgtggggggtccctgagactctcctgtgcagcctntggattcaccttnagtattttangctatcgctacgtgggtcccnccgaggcctaccgaagggaacgggactaggaatagtcgtactcgtaggttaattaaggaagtaagtcggaacgaataaacattaactattatacgactaaacttctaggtaggaacgggctaagtacttaccaaccgtacttccgtacccgaagggtaacctaaacttaccgaaacgaacccgaacgtacttagttaacttaccttaacgaagtcggacacgcgtagagacgtacgtacggacggacgacggttctagttacgtacgtttaacggtgggtaggggacgtaaggggacgtaacgggtaaggttacgggtaaacgggtttggggttacgggtccggggacggtaacgggg

SEQ ID NO: 268602 - DNA, 743 bp, Homo sapiens
  misc_feature: GYAE6OF02HGP66.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttatttttaaaggtgtccagtgtgaggtgcagctggtggagtcgtgggggaggcgttggtccagccgtgggggggtccctggagactctcctgtgcagcctcgtggacttcaccttcagttatttagtgctatggcacgtcgggtcccgccaggcctccgaaggggaacgggactggaatagtcgtactcgaggttaagttaaggaagtaagtcgacgtaaataaactattaataattatgtaactaaacttacgtggtaggaacgggtcaaggtaacttccgaaccctacgttacctaccgaacgggtaaactaaacgttacccaaagaaacccgtacgtaccgttaacgttacttaccgtttaacgaaaacggtcggggactacggacccgttaggaaccgggtagtaccggttaggaaaccgggaccgtaccgggtacgtttacggttaacttaacggtttacgggttaggggttaacggggagggtaaacgggtacgggtaagggttaaacggtttgggggaaaccggtttacgggggggttttcggggtaacgggggtacccgggtaacgggggg

SEQ ID NO: 268603 - DNA, 787 bp, Homo sapiens
  misc_feature: GYAE6OF02HS8KD.28.57.F02.1.454.CMB.1.raw
  modified_base (255)..(255): a, c, t, g, unknown or other
  misc_feature (255)..(255): n is a, c, g, or t
  modified_base (286)..(286): a, c, t, g, unknown or other
  misc_feature (286)..(286): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggtttttccttgttgcttaatttttaaggtgtccagtgtgaggtgcagctggtggagtcgtgggggagcttggtccagccgtggggggtccctgagctctcctgtgcncgcctcgtggattccaccttcagttatttangtctatgcctacggtcgggtcccgcctaggcctaccggaggggaaacgggcctaggaatagtcgtacctagtaaggttaagttaagaaagtaagtcgtaccgtaaaataaactaattaagtttaattaacgtagtaaacctaaaccgttgtttaagggacggaaaacggggtctaaacggttactttacccgaaccgttaacgttacccgtaaccggaaacgggttaaaccttaaaacccttaaccgaaaacggtaacccgtaaccgttcccgttaaagtttacccttaacgtttaaacgaaacggttaccgggtacaccgggtaaccttagggaacgacgtcggaaacgtaaccgggaacgtacgggttaccttaagttacttaacggttttcgggtaaagggtacggggagggaacgggttaggaaccggggtttaagttaacgggggtaaccgggtttaggggggtttacgggaccggggtacgggttaacccggggg

SEQ ID NO: 268604 - DNA, 668 bp, Homo sapiens
  misc_feature: GYAE6OF02FQW7B.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggagcttggtccagccgtggggggtccctgagactctcctgtgcagcctctggtattcaccttcgagttattactgtctatgcacgtggtcccgcaggtcctaccgaagggaacggactggaatcgtgttctcgaggtattaggaagtaatggacgtaaataacgattataattagtacgactaaacttcgtaggtaggtaacgggctagtacttacacactcacgacgggtactaacgtaccgaacgactcgtactagtacttcttaagaaagtcgggtaacacggtaccgttaggaagtacggacgttagggaaaccggaccggtacggtacttaggttactttacggttacgttcggggttagggaaacgggtagggtaaccggtaggggttaaacgggttgggtaaaccgggtttcggggggtacggtttaccggggggaccttaaccggggggg

SEQ ID NO: 268605 - DNA, 939 bp, Homo sapiens
  misc_feature: GYAE6OF02HW4S0.28.57.F02.1.454.CMB.1.raw
  modified_base (313)..(313): a, c, t, g, unknown or other
  misc_feature (313)..(313): n is a, c, g, or t
tcagagtacgctatcacgaccggtgctcgatttagctcgatatagttgggtctgggagaggagcccccgcccctgggtttcccaggtgttctcatttggtgatcagcactgcacaacagaagagtcatgacggagtttgggctgagcttgggttttccttgttgcttaatttttaaaggtgtccagtgtgaggtgcagctggtggagtcgtgggggaggcttggtccaggccggtgggggggtcccctggaagtacctctcctggtgccacgccctcgtggactttccacccgtttctaagttaatttttaancgttaccttattcggcctaccggttcggggtccccgtaccccgtaacggggtcccttacccggaaggggggtaaacgggggtaaccgttagggaaaactttacgttacggtttaccttacgggttaaagggttaaacttttaaagggtaaaaggttaaacgtttaacggaaaccggttaaaaattaaaaaccgttaatttaaacttttaaagtttaataaccggtaacctaaaaccctttcgtacggggtaaacgggtaaacggggtaccttaacggtaacgtttaccctaacccgtaaactttccccgtaaaccggtaaccgggaaacttaaaccgttaaccccggaaaaacaaacccgtaaccgttactttacggtttaaactttaccggtttaactaaaacgggtccgggaacctaaccggtaccgttacggaaacggggtacgtcgggtaagggaaccgggtaaccgacgggtttaaccttagggtttaaccttttaaggttacccgggttggggtaacgggggtacggaaaggggttaccggggtaaggttaaacgggttacgggttaaaccggggtttaggggggttacgggttaccgggggggtcccggtaaacggggg

SEQ ID NO: 268606 - DNA, 820 bp, Homo sapiens
  misc_feature: GYAE6OF02HSKZ0.28.57.F02.1.454.CMB.1.raw
  modified_base (276)..(276): a, c, t, g, unknown or other
  misc_feature (276)..(276): n is a, c, g, or t
  modified_base (430)..(430): a, c, t, g, unknown or other
  misc_feature (430)..(430): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagcttgggttttccttgttgctatttttaaaggtgtccagtgtgaggtgcagctggtggagtcgtgggggagcttggtccagccgtggggggtccctgagtactctcctgtgcagcctctggacttcaccttnagttatttatcgtcttatgcctacgtcgggtcccgacccgacggtccctaccggaaggggaacgggtacctagggtaaattacgtcgtcgttaccgtaggttaacttaagaaaggttaatacggacgtaaataaacgtaattaatttaattaanacgtaaactaaacttcgttaaggtacgggaaagggcctaagttactttaccgacctaaacttcccgtacgtaacgggaaaccttaaccgttaaaccgaaacgtaaccgaccgttaccgtttacgttaaccttacgtttaaaccgaaaggtcgggtaaccctaaacggtacccggttaagggtaaccggacggtacggtttaacgggaaacccggggttaaagccccgggttaacgttagttttaaccttaacgggttttaccggtagggggtaacggggttaaacgggaaccggggttaagggttacccggttaaaggggtttttaccgggaaacgggggtttttacggggtttaagggggttaccccggggggtaaccggtaacggggg

SEQ ID NO: 268607 - DNA, 693 bp, Homo sapiens
  misc_feature: GYAE6OF02GF2EL.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggacgactctcctgtgcagcctctggattcaccttcagttatttatgctatgctacgtcgggtcccgccgaggtccgtaccgaggggaacgggacgtagggaatagtgtctacgtaggtagttaagaagttaatagacgaaataacattattattatgtacctaaacttctaggtaggaacggctagtaacttcaacctagtcctaccgaagggaacctaacgttaacccaaacggaacctacgtacttacgttaacttaccgttaacgaaacggtttcgggaccctaacgggaccttaaggacgtaacggtccgtacgggacggtacctaacgggtcttaagttattaacgtttacggtcggggttaaggggacggaagggtaacggtacgggttaaacgttacggggtaacgggtttaggggtttcgggggtacggggtccctaacgggggg

SEQ ID NO: 268608 - DNA, 639 bp, Homo sapiens
  misc_feature: GYAE6OF02GFD4Y.28.57.F02.1.454.CMB.1.raw
  modified_base (306)..(306): a, c, t, g, unknown or other
  misc_feature (306)..(306): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcagcctctggattcaccttcagttatttatgcttatcgcacgtcgggtcccnccgaggcctccgaaggggaacgggacgtagggaatagtgtactcgtaaggttattaagaagttaagtgtacgaaataaacattaattaattagtagaacctaaactcgtagtaaggaagggactagtacttaccacctacgtcctaccggaagggaacctaaacgttaccgaaagaacccgacgtactagttacttaccttaacgaaggtcgggacctaggccgtagacgagtcgtagacgacgtacggcttagtacttagttacgtgggaggaaggaggacggacggtaagttacgggtaacggttagggttgggtacgggacgtaacgggg

SEQ ID NO: 268609 - DNA, 720 bp, Homo sapiens
  misc_feature: GYAE6OF02FPAXZ.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggcttggtccgagccgtggggggtccctgagactctcctgtgcagcctcgtggattccaccttcagttaatttatgtcttatcgctaccgtggggtcccgaccgagggtcctaccggaggggaacgggacgtagggtaatagtcgttactcgtaacggttagttaagtaacgtaaatcggacgtaaataacagttaattatttagagacctaaatcgtagtaggaaggcagtactacacacgtctaccgacgggtaactaacttaccgaaacgtaacgaccgttacgtagttactaccgtttaacgaacgtacgggacaacgtcctagggtaagacggtaccgttaggaacggtaccggtaacggtccgttaaggttacttaacggttaccggtagggttaaggggtaacgggtaaggggtaccggttaacgggtttaaagggttaacggggttaaaccgggtttacggggtttaggggtacccggggtaccggggtaaccgggggg

SEQ ID NO: 268610 - DNA, 600 bp, Homo sapiens
  misc_feature: GYAE6OF02H8FW5.28.57.F02.1.454.CMB.1.raw
  modified_base (178)..(178): a, c, t, g, unknown or other
  misc_feature (178)..(178): n is a, c, g, or t
  modified_base (257)..(257): a, c, t, g, unknown or other
  misc_feature (257)..(257): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (465)..(465): a, c, t, g, unknown or other
  misc_feature (465)..(465): n is a, c, g, or t
  modified_base (503)..(503): a, c, t, g, unknown or other
  misc_feature (503)..(503): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcttgggttttccttgttgcttattttttaaaggngtccagtgtgaggtgcagctgggtggagtcgtgggggagcgttggtccagccgtggggggtccctgagactctcctgtncagcctctggattcctaccttcaagttactttangtctatcgcacgtcgggtccncccgaggtcctaccgaggggacggacgtaggattagtcgtctagtagttatagaagtatagacgtaataacattaattatatagacctaatcgtaggagaggctagtactccacctatcctacgaacggtactactacccaaagacctacgtnttactacttcttaagaatcgggcgtacgtccgtagagngcgtagaacggagcgtacgtatcgttattcgtgggacggtagacggaggtaacggtaggttacgaagggttttggtacgggacgggtaccgtagggg

SEQ ID NO: 268611 - DNA, 717 bp, Homo sapiens
  misc_feature: GYAE6OF02GO752.28.57.F02.1.454.CMB.1.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (443)..(443): a, c, t, g, unknown or other
  misc_feature (443)..(443): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgtagctattttaaaggtgtcagtgtgaggtgcagctgtggagtctgggggaggcttgggtccagccgttgggggggtccctggagactctcctgttgcacgcctcgtggtaactttcacccgttntaagtattttangtctatcgcgacgtgggtccgaccgacggctacccgaggggaacgggaccgtagggaattagtacggtcgtacgtaggttaattaggtaaagtaacttcggaacggtaaacttaacaagttaattaaggttaattacggaactaaaccgttntaggttagaaggggtactaggactttacacgtaactcgtaccgacggtaaactagttaaccgaanaacgtaactccgtatacgtacctaataacgtcgggcaacgttccaggtaacgtacggacgtacgggaacggaacgtacgggtaccttaggtttaacttacggtttaaccgttacggggttaaggaacgggtaaggttaacgggtacggtaacggttaacgggttaaaccggttacggggttaggggttaccggggaccggtaaccgggg

SEQ ID NO: 268612 - DNA, 737 bp, Homo sapiens
  misc_feature: GYAE6OF02GWHN2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggggttttccttgttgctatttttaaaggtgtccagtgtgaggtgcagctggtggagtcgtgggggagcttggtccagccgtggggggtccctgagactctcctgtgcagcctctggattcgaccttcagtatttatgctatgcacgtgggtccgcgaggctccgagggaaggactggaatatgtctacaggtattagaagtaatgacgtaaataacattaatatatgactaaatcgtagtaggtaaagggctaagtacgtttccaaccgtatacccgtacccgaaggggtaaaccctaaacgtttaacccgaaaacggtaaacccgtaacggtaaccgtttaacgttaacgttaccctttaaacgtaaaacggtacggggtaacctaaaccgggtaccccgttaagggaacggtaacggtaccgttaagggaaacgggtacccgtaaaccgggttaccttaggtttaacttaacgttttaaccggtgggtaaagggggtaacgaaggggtaaaccgggtacggttaaaggtttcgggaaacgggttttaacgggggtttaggggttacgggggtaccggtaaccgggggg

SEQ ID NO: 268613 - DNA, 593 bp, Homo sapiens
  misc_feature: GYAE6OF02GOQYI.28.57.F02.1.454.CMB.1.raw
  modified_base (330)..(330): a, c, t, g, unknown or other
  misc_feature (330)..(330): n is a, c, g, or t
  modified_base (523)..(523): a, c, t, g, unknown or other
  misc_feature (523)..(523): n is a, c, g, or t
  modified_base (557)..(557): a, c, t, g, unknown or other
  misc_feature (557)..(557): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtctggggggagtcttggtccagccgtggggggtccctgagactctcctgtgcagcctctggacttcaccttcagttatttatgcttatcgctacgtcgggtccgccgaggctccgaggggaaggacgnggtaatagtgtctcgaggttatagaagtaagtagacgtaataacgataactattatagactaaacttcgtaggtagaacgggacagtactccgtaacctctacgtaccgaagggtaactaacttcccaaaggaaaccacgacttagtaacgttaccttaacaaaggttccgggacaacgtccgagagctacgngacgagccgatagtactacttcggaggtcgaagngagtcggattagggaactgggtcgacgggcgtaggg

SEQ ID NO: 268614 - DNA, 677 bp, Homo sapiens
  misc_feature: GYAE6OF02GUK0H.28.57.F02.1.454.CMB.1.raw
  modified_base (298)..(298): a, c, t, g, unknown or other
  misc_feature (298)..(298): n is a, c, g, or t
  modified_base (388)..(388): a, c, t, g, unknown or other
  misc_feature (388)..(388): n is a, c, g, or t
tcagagtacgctatcacgaccggtgctcgatttagctcgatatagttgggtctgggagaggagcccccgccctgggtttcccaggtgttctcattggtgatcagcactgcacacagaagagtcatgacggagtttgggctgagctgggttttcctgttgctatttttaaaggtgtccagtgtgaggtgcagctggtggagtcgtgggggaggtcttggtccagccgtggggggtccctgagactctcctgtgcagcctctggattcacttcagtatttatgctatgcacgtgggtccnccgaggcctaccggaggggaacgggactagggtaactagtcgtctcgagggttattaggaacgtagtagacgtaataacatattaattancgtactaaactctggtaggaagggcagtattcgaccattcctaccgaagggtacctaacgttaccgaaacgaacctacgacttagtaacttccgtaacaaaggttcgggaactacggtacctaggacggtacgtcggtaggaacgggaccgtaaacgggtccgttaaggttaaccgttagtttaccggtggggtttaacggggaaggtaacggggtaacggtaacggttaaggtttaaccggggtaaggtttagggggtttcgggtaccggggggacgttaacgggggg

SEQ ID NO: 268615 - DNA, 571 bp, Homo sapiens
  misc_feature: GYAE6OF02IUDT5.28.57.F02.1.454.CMB.1.raw
  modified_base (303)..(303): a, c, t, g, unknown or other
  misc_feature (303)..(303): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtgggggtccctgagactctcctgtgcagcctcgtggattcaccttcagttatttatgtctatgcacgtcgggtccnccgaggcctcggaggggaaggacgtggaactgtcgtctcgaggtattagaagtatgacgaatacatatattatgactaactctgagaggnagtactacacatcacgagaactactacanacncgctatactctagaagtcgnacgtcagacgtagctggagaccnggtactagtatagtttacggnggtacgggaagtacgggaaggtacggttaaggttaccggggttaaagttcgggggttacggttacgggggaccgtacggggg

SEQ ID NO: 268616 - DNA, 670 bp, Homo sapiens
  misc_feature: GYAE6OF02G7IYZ.28.57.F02.1.454.CMB.1.raw
  modified_base (211)..(211): a, c, t, g, unknown or other
  misc_feature (211)..(211): n is a, c, g, or t
  modified_base (547)..(547): a, c, t, g, unknown or other
  misc_feature (547)..(547): n is a, c, g, or t
  modified_base (567)..(567): a, c, t, g, unknown or other
  misc_feature (567)..(567): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttgggttttcctgttgcttaagttttttaaaggctccgagtgtgaaggtgcgagtcgtggtaggnggtcgggtggggacgttcgttccggccgtaggtccggggttcgggggtacccttagaacgtaccttccgtccgtggtacgcgtacggtccctgtacggtaacttcccgaaccttgtaagtttattacgtcgtacctgtacgcgtacgttcgggcccagtacgccgacggaagggaacgtacgtaggtaaatcgttcgactaggttaaagtaagtaagaaagttgacggtaaacgaactaaacgtatttaacgttaagacaacgtacctaaaagttcggtaagtaccggaggtaacctagtactacgactactacgtaacgagtaactaactacganactgatacttacagtagagnggacagcgtanagcgtanacggacgacgcgtatagtattacggtagtcgggtagacggtagacgtaagtaggtacggtaggtgggtacggtcggacggtacgg

SEQ ID NO: 268617 - DNA, 728 bp, Homo sapiens
  misc_feature: GYAE6OF02JU67W.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcttgggttttccttgttgctatttttaaggtgtccagtgtgaggtgcagctggtggagtcgtgggggaggcgttggtccaggtcccgtgggggggttccctaggagaccttcctccgtggtcgccacgccttcgtggtactttccaccttcgtagttactttatgtaccttagtccgactacgtcgggttcccgacccggaggccttaccgggaggggtaacgggtacgttaggaattaccgttggtaccttacgaagggttattaaggtaaagttaacgtggaacgtaaactaaactattaactttagttactacgaaaccttaaccgttcgtacggaaggtacgggactagtactacgtaccgtatacctaccgaaggtaactaacgttaaccgaaacggtaacaacccgtctttaacgttactaactaacgtaaacggtcggactaccggctagggagtaccgtagtaggaacgtacgaacgttcgttagtacttacgtacggttggagggtaacggaggtaccggtaggttaacggttcgggtaaggttaggggtcggggttacgggacggtaacgggg

SEQ ID NO: 268618 - DNA, 724 bp, Homo sapiens
  misc_feature: GYAE6OF02IQUBQ.28.57.F02.1.454.CMB.1.raw
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
  modified_base (383)..(383): a, c, t, g, unknown or other
  misc_feature (383)..(383): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagcgtgggtggagttcggtgggggaggtcgttgggtccaggcccgtgggggggtccctaggacgtactcgtccgtgtgcagtcctcgtggacttccaccttcgagttatttagngtactatcgctacggtcgggtcccnccgaggcctaccggagggaacggctaggaatagtgtctgtagtagttagaagtangtacgaataacgtattatattagtagactaaacgtctaggtaagagggtacaagtactttccgaaaactcgttaccgtaaccggtaacggtaactaaacgttaacccgaagaaacccgttcgaccgttagttaactaccgtaacgtaagtcgggtacacgtccgtagacgtacgtagtacgggtaacgaccgtaacggtacttacggttaaccttaaaggttccggttaaggggaaccgggtaaggtaaccgggtacggggtaaacgggttaacggtttaacggggtaaacgggtttacgggggtaacggggtaccgggggtaacccgtaacccggggggg

SEQ ID NO: 268619 - DNA, 705 bp, Homo sapiens
  misc_feature: GYAE6OF02FMRKS.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagcgtggtggagtcgtgggggaggtcgttggtccagccggttcgggggggtcccttggacgtacctcctccgtgtcgcacgcctcgtggtacttccaccttcgtagttattatgtactatcgctaccgtcgggtcccgccgacggtcctaccggaggggaacggtacgtaggtaatacgtcgtctagtaggttataagaagtatgactaataactataatattatacgactaactcgtagtacggaaggactagtactacaccgtactacgtccgaaggaaccttaacgtaaccaaacgtaacctcggtactaaggtttactaataaccgtaaaggttcggacgtaacgcgttacgaggtacgagttaccggaacggaccgtacgtacgttagttaacgttacggttaggtacgggtaagggtacggtaagggtaacggttacgggttaacggtttaaccgggttaaacgggggttcggggttaacgggtaccgggggtacccggtaacggggg

SEQ ID NO: 268620 - DNA, 689 bp, Homo sapiens
  misc_feature: GYAE6OF02JYHY4.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctccgtgtgcagcctctggattccaccttcagttactttatgctatgctacgtggtacccgccgaggtcctaccgaggggaaggacgtaggtaatacgtgtacgtacgaggttataagaagtaatggacaagtaaactattaatacttaagtcgtaaactaaacgttcgtaggttacggaacgggtctaaggtacttaccaacctacgttaccctaccggaagggaccttaaacgttaacccgaaacgaaccgtctagttacttaattacctaacgaacggtcgggtacacggttaccgtagggagtaccgtagtagggtaacgaccggaaacggtcttaagtatttaacggttcggtgggtaagggaaggtaacggtaggtaaccgttaaggttaacgggttaaccggttaggggtaacgggttccgggaacccgggtaggg

SEQ ID NO: 268621 - DNA, 621 bp, Homo sapiens
  misc_feature: GYAE6OF02GSEWC.28.57.F02.1.454.CMB.1.raw
  modified_base (299)..(299): a, c, t, g, unknown or other
  misc_feature (299)..(299): n is a, c, g, or t
  modified_base (401)..(401): a, c, t, g, unknown or other
  misc_feature (401)..(401): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttcctgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtcccncgaggcctccgagggaagggactggaatatgtctgaggtatagaagtatgacgaataacatatattatgacaaactctgtaggaagggcagattccactacnctccgaagggaactaacttacaaacacacgctagtaacttctacaagtcgggacacgtaccgtgaagacgtacgtaggaacggaccgacggtactaggttacttaagtttaacggttcgggtagggggtaacggaaggggtacggaacgggtaaggtttacggggtaaaccggtttaaggggggtttacgggttacgggggtaccccgggtaacgggggg

SEQ ID NO: 268622 - DNA, 871 bp, Homo sapiens
  misc_feature: GYAE6OF02INDHT.28.57.F02.1.454.CMB.1.raw
tcagagtacgctatcacgaccggtgctcgatttagctcgatatagttgggtctgggagaggagcccccgcccctgggtttcccaggtgttctcatttggtgatcagcactgcacacagaagagtcatgacggagtttgggctgagcgtgggttttccttgttgcttatttttaaaggtgtcctagtgtgaggtgcagctggtggagtcgtgggggagtcgttaggtccagccgtaggggggtccctgacgaccttcctccgtggtacgtcacgtccctacgtaggactttccaaccctttctaacgtttattttaagtcgtaccttagtcggaccgtaccggttccggggttcccgacccgtacgggtaccttaccccgggaaggggggtaacgggtaaccgttagggtaaacgttagttacggttacccgtacgttaaacggttaagtttaacggtaaagtaaacgttcggtaaccgtaaaattaaaccgtagtttaaactttaagtttacgtaacggtaacctaaaactttcgtaggtaacggaacggggtactaagggtacttacccggaaaccctacgttaacccgtacccggtaagggtaaccctaaacgttaccgaaaaggtaacccgtacgtaccgttagtaaccttaccgtaacgtaaaggtccggtacacgtaccgttaaggagtaccggtacgtaaggtacccggaaccggtacccgggttgttaacgttacgttaacgttttaccggtaacggggttaccgggaaggttaccggggtaaggtaacgggttaacgggtttaaccgggtaaccgggtttacgggggtttacgggtacggggggtaaccccggttaccggggg

SEQ ID NO: 268623 - DNA, 743 bp, Homo sapiens
  misc_feature: GYAE6OF02HTG36.28.57.F02.1.454.CMB.1.raw
  modified_base (266)..(266): a, c, t, g, unknown or other
  misc_feature (266)..(266): n is a, c, g, or t
  modified_base (288)..(288): a, c, t, g, unknown or other
  misc_feature (288)..(288): n is a, c, g, or t
  modified_base (389)..(389): a, c, t, g, unknown or other
  misc_feature (389)..(389): n is a, c, g, or t
  modified_base (419)..(419): a, c, t, g, unknown or other
  misc_feature (419)..(419): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgaggtagtttgggctgaacttgggttttccttgttgtcttaagtttttaaaggtgtccagtgtgaggtgcagcgtggtggagtcgtgggggagtcgttggtcccaggtccggtggggggtccctgagactctcctgcgcncgcctcgtggattccaccgttnaagttatttagcgtctagtgctacgtcgggtccaccgagtcctaccggaaggggaacggtacgtgaaatgtcgtcgtagaaggttagttaaagtaagtaancgaacgtaaataactaattaatatttacgngtaaacctaaagttcgttaggaagggaaagggcctaaaggtaacttaccgaaccctaagttacccgtaaccgaaaggtaaaccgttaaacttaaaccgaaaacgtaaacgacggtcttaacggtttactaacttaaccaaaaggcggtaaccgaccggttaaccgtaggtaaacggccttacggtacggaacgggaccggaacgtagtacgttaagttaacgttaccgtttagggaaggggtaacgaaggggaacgttaacgggaaagtttacggggaaacggtttacgggggacgggttcggggaccggtagggaaccccggg

SEQ ID NO: 268624 - DNA, 765 bp, Homo sapiens
  misc_feature: GYAE6OF02GQ9E2.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagcgttggtccagccggtcggggggtccctgagtacctctccgtgtcgcacgcctcgtggtacttcctacctttcaagtttatttagtcgtacttatgtacgtacgttcgggtcccgccgacgggcctaccggaagggggaacggtaacgtaggtaattacgtcgttactacgtaaggttaacgtttaaggtaaacggttaagtcggtaacgtaaaacttaactaattaactttaagtttaacgagtaacctaaacttcgttaagtagggaacggtacgtagtaacctacccgaactacgttccgtaacggtacggtaactaaacttaccgaaaccgaacgtaccgttattaacgtttacttacgttaacgtaaacggtcgggaccctaggtacccgtagggacgtacgggtcgtaagggaaccggtaccggtacgggttacttagttacgttacgttaaccgggttgggtaaggggaccgggaagggttaaccggtaggtaaggttacggggttggttaagggggttcggtaccgggggacgtaaccggggg

SEQ ID NO: 268625 - DNA, 860 bp, Homo sapiens
  misc_feature: GYAE6OF02IUZHW.28.57.F02.1.454.CMB.1.raw
tcagagtacgctatcacgaccggtgctcgatttagctcgatatagttgggtctgggagaggagcccccgccctgggtttcccaggtgttctctatttggtgatcagcactgcacacaagaagagtcatgacggtagtttgggcgtgagcgttgggttttccttgttgtcttaagtttttaaaggtgtcctagtgtggaggtgcgagtcgtggtggtagtcccccccccccggtgggggaggtcgttcggtccgacggtccggtcgggggtcccgtgacgtactccgtcctgtcgcgacgtcctcgtggtattcctacccttcctagtaatttatgtcttatgacgtacgtcgggtcccgtcccgacggtcgtccgaggggaacgggacgtaggaactaagtcgtcgtaccgtaaggttagttaagtaaagtaaagtagtaacgtaaataaactaagttaattaattaatacgtaacgtaaacttactacgtaggtaacgggtacgtaaggtacttaccaaccgtatacccgtaccgtaacgggtaaactaaacgttaccgaaaaacgtacccgaaaccggtacctttaaggttaaccttacctttaaacgtaaaaacggttcggggtaacctaacggtacccgtaagggaaccggtaagtccgttaaaggggaaaccggtaacccggaaaccggtcggttaaactttaggttaaaaccgttttaacgggaaccggggttttagggggaaacgggttaaaccggggtaacggttaaccggggttaaaaggttttaaccggggaaacggggttttaaacgggggtttaggggttaaccgggggacccgttaaacgggggggg

SEQ ID NO: 268626 - DNA, 708 bp, Homo sapiens
  misc_feature: GYAE6OF02I7JVJ.28.57.F02.1.454.CMB.1.raw
  modified_base (510)..(510): a, c, t, g, unknown or other
  misc_feature (510)..(510): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtgggggtccctgagactctcctgtgcacgcctcgtggtacttcctacccttcagttaattttactgtcctagtgacgtacgttcggggtcccgccgacggcctaccggaaggggaacgggacgtagggaatagtgtctacgtaggttaattaaggaaagttaagtgaacgaaataacaataattaattatacgactaaacctcgtagtaggaacgggcaagtacgttaccaacctacgttacgtacccgaaggtaactaaacgttaccaaagaaccacggtntattactcttaacgaagtcgggacagtccgtaggacgacgggtagacggaacggaccgtaacggttacgtaacggttacttaacggttacggtggggtaacgggaaggggtaacggtaaggggtaccggttaagggtttaacggttaacggggtttacggggtttacggggtaccgggggtaaccggtaaccgggggg

SEQ ID NO: 268627 - DNA, 650 bp, Homo sapiens
  misc_feature: GYAE6OF02H8J8L.28.57.F02.1.454.CMB.1.raw
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgcttatttttaaaggtgtccagtgtgaggtgcagctggtggagtcgtgggggagtcttggtccagccgtcggggggtccctgagactctccgtgtgcagcctcgtggtacttccaccttcagttattttangcttatgctacgtcgggtccnccgaggcctccgaaggggaggacgtaggaatagtgtctgaggttataagaagtagtgacgaataacataattattagactactaaacgtctggtaggaacgggcaagtattccaacatccgacgaaggtaaactaccgttaaccaaagaacccgtacgacgtttacgtaccttaccgttaacaaaggttcggactacgccgtaggaagtcggctagggaacgtaccgacggttcttacgtagttacttaacgggtggttacggggaagtaaggggacgtacgggtaagtttcgggaaaccgggtttagggttcgggggtaccgggaacggtacggggg

SEQ ID NO: 268628 - DNA, 757 bp, Homo sapiens
  misc_feature: GYAE6OF02G25ID.28.57.F02.1.454.CMB.1.raw
tcagagtacgctatcacgaccggtgctcgatttagctcgatataggttgggtctgggagaggacgcccccgccctgggtttcccaggtgttctcatttggtgagtcagcactgcacacagaagagtcatgacggagtttggctgagcttcggttttccttgttgcttaatttttaaaggtcgtcctagtgtgaggtgcgagcgtggtgtagtcgtggggagtcttggtccagccgtgggggtccctgacgtactctccgtgtggcacgtcctcgtcggtaattcccacctttacgaagtttaacttttaagtgtacttagtcggtcacgtcgggtaccgccgacgccgtaccggaagggtaacggtcgtagtaagtgtcgtcgtacgtaaggttagttaaacgaagtaacgtcggaacgtaaattaaacgtattaattacttagtaacgtactaaacccgttgtacggtaggtaaacgtctaaggttaacttaccaacccgttaaatcccgttaacccggaaggtaaacccgtaactttaacccggaaaacgttaaccaaccggttacttacgttaacgttaccgttaaacgtaacgttagggacctaacggtacccgtagtaacgacgtacgttcgggaaacgtaccggtacgtacgtttaaggacgtttacgttacgggtgggtagggtacggtaggtaccggtaggtaacgttccgggtaaggtttcgggtagggtaccgggtcccgtaagggg

SEQ ID NO: 268629 - DNA, 777 bp, Homo sapiens
  misc_feature: GYAE6OF02FOE79.28.57.F02.1.454.CMB.1.raw
  modified_base (262)..(262): a, c, t, g, unknown or other
  misc_feature (262)..(262): n is a, c, g, or t
tcagagtacgctatcacgaccggtgctcgatttagctcgatatagttgggtctgggagaggagcccccgccctgggtttccccaggtgttcctcatttggtgatcagcactgcacacagaagagtcatgacgggagtttgggctgagcttgggtttttccttgttgcttatttttaaaggtgtccagtgtgaggtgcagcgtgggtggagtcgtaggggggaggcttggtccagccgtggggggtccctgagtactctccgngtgcacgccttcgtggacttccaaccttttcgaagttttatttacgtgtccttatcgacgtaccgtcggggtcccgacccgacgggtcctccgggaaggggaacggtacgtaagggtaattacgtggttcccttaggtaaggttagttaaacggtaaagttaacgtcggtaacgtaaaataaacgtaatttaataacgtttagttaaccgaacttaaaccgttcgttaggtacggaagggtaccaagtaacttccacctacgtcctaccggaaggtaacctaacttacccgaaagaacctacgttactagttacgtaccttacgtaagtacggtacgactacgtagacggtacgtaccgtaggaaccgtaccgtacgggtacgttaacgtttagttaacggttacggtaggggtaacgggtacggggtaacgggtacgggtaaccgggttaacggtttaacggggaaccgggtttaggggttaccggggtaccgggggtaccggtaaccgggggg

SEQ ID NO: 268630 - DNA, 754 bp, Homo sapiens
  misc_feature: GYAE6OF02JB2CJ.28.57.F02.1.454.CMB.1.raw
  modified_base (212)..(212): a, c, t, g, unknown or other
  misc_feature (212)..(212): n is a, c, g, or t
  modified_base (328)..(328): a, c, t, g, unknown or other
  misc_feature (328)..(328): n is a, c, g, or t
  modified_base (407)..(407): a, c, t, g, unknown or other
  misc_feature (407)..(407): n is a, c, g, or t
  modified_base (447)..(447): a, c, t, g, unknown or other
  misc_feature (447)..(447): n is a, c, g, or t
  modified_base (508)..(508): a, c, t, g, unknown or other
  misc_feature (508)..(508): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggtagtttgggctgagcttggggtttttccttgttgcttagtttttaaaggtgtccagtgtgaggtgcagctggtggagtcgngggggaggcttgggtcccaggcccggttgggggggtcccctggaacgtaccttcctccgtggtcgccacgccttcgtggactttccacccgtttcagtttactttatgtctatgcncgtcgggtcccgcgacggaccttccgaaggggtacgggacttaggaattatcgtctacgaaggttattaagaagtacgngaccgtaaattaacattaatttatactgaaactaaacttntacggtagaagggactagtacttaccaaccatccctacgaacggaactaacgttaccgaanaccgtacttctagttactaccttacgaacggtcgtaacgtcgacgtaggaagtacgtacgtaggaacggtaccggtacggtaccgttagtttacgttaacgttttacgggtttaacgggggtaaggggtaaccgggaacgggtaacggggttaacgggtttaaccgggtttaagggggttaaaaacccggggttttggggggggttaacccgggtttacgggggggaaccccggttaaccgggggg

SEQ ID NO: 268631 - DNA, 652 bp, Homo sapiens
  misc_feature: GYAE6OF02JP47L.28.57.F02.1.454.CMB.1.raw
  modified_base (186)..(186): a, c, t, g, unknown or other
  misc_feature (186)..(186): n is a, c, g, or t
  modified_base (260)..(260): a, c, t, g, unknown or other
  misc_feature (260)..(260): n is a, c, g, or t
  modified_base (269)..(269): a, c, t, g, unknown or other
  misc_feature (269)..(269): n is a, c, g, or t
  modified_base (415)..(415): a, c, t, g, unknown or other
  misc_feature (415)..(415): n is a, c, g, or t
  modified_base (490)..(490): a, c, t, g, unknown or other
  misc_feature (490)..(490): n is a, c, g, or t
  modified_base (526)..(526): a, c, t, g, unknown or other
  misc_feature (526)..(526): n is a, c, g, or t
  modified_base (569)..(569): a, c, t, g, unknown or other
  misc_feature (569)..(569): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctggtttccttgttgctattttaaggtgtccagtgtgaggtncgagcgtggtggagtcgtgggggaggtcttggtccagccgtggggggtccctgacgctctcgtgtgcgcgcctnggtattccnccttacagttactttatcgcttatagccgtacgtccgggtccgccgaggtcctaccggaggggaacgggacgtaggaacgttacgtgtccgtacgtaaggttattaaggtaagtactgaacgaaatacgtataagttattacgtanactaaacttacgtggtacggaaggtcaagtcgtaacacctagtcccacggaacgtaactactaacgaaccgtaanacgtctagtactcgttaaacaggtcggcaacggtcnggaagctagtacggacgacgtaccgtgtagtacttaggttcgnggggttacgggaaggtacgaggggttactaacgggtcgggttaaacgggtttacgggttacgggagggttaacccggtacggg

SEQ ID NO: 268632 - DNA, 719 bp, Homo sapiens
  misc_feature: GYAE6OF02HPIXE.28.57.F02.1.454.CMB.1.raw
  modified_base (265)..(265): a, c, t, g, unknown or other
  misc_feature (265)..(265): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (514)..(514): a, c, t, g, unknown or other
  misc_feature (514)..(514): n is a, c, g, or t
tcagagtacgctatcacgaccggtgctcgatttagctcgatatagttgggtcgtgggagaggagcccccgcccctgggtttcccaggtgttctcatttggtgatcagcactgcacacagaagagtcatgacggagtttgggctgagctgggtttccttgttgctattttaaagtgtcagtgtgaggtgcagctggtaggagtcgtggggggagtgttcggtccagccgtgggggggtccctgagactcgtcctgtgcagtccctntggtcttaccacctttacaagttatttaactgtctaatgctacggtcgggtcccgccgacggcctccggaagggaacgggtccaaggtagtagtgtctacgaggttaagttaaggaaacgttaanacgagtaaactaaactattaagttaatcgtaanattaaaacctgtacggtaaggaacgggtacaagttaactactaacccaattcctaccggtaagggtaaaccctaaaattaacccggaaaanaaaccggtaaccgtaccgtttagtaacttaccgtaaataaacggttacgggaacttaccgaccgtaagaacggttaaccacggttacgaacgggaacgtaccgaacgttacgttacttaacgttacggtaggttaagggaggaacgggtaagtacgggtaattaccggggtaaagttacggggtttgggacggacgggtaacggg

SEQ ID NO: 268633 - DNA, 701 bp, Homo sapiens
  misc_feature: GYAE6OF02GABEQ.28.57.F02.1.454.CMB.1.raw
  modified_base (533)..(533): a, c, t, g, unknown or other
  misc_feature (533)..(533): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctggagacctctcctgtgcagcctctggattcacccttcagttatttatgcttatcgctacgtcgggtcccgcccgagggcctccgaagggggaacgggactagggaatatggtctgaggttaattaagaagtatgacgtaaataacattaattattatagactaaactcgtaggtagagggacagtacttccgacctacttcctaccgaagggtaactaacttaccgaaacgaaccacggttactagttaacttccttaacaaacggtgggactaggtaccctaggaacgtacgnggtacggaacggtaaccgacgggtaccttaaggttaccgttaagtttaccggttaggggtaaggggttaacggggaagggtaaccgggtaacggtttaaaggttaacgggggttaaaccggtttaggggggtttaccggggtacgggggtacccgggtaacggggggg

SEQ ID NO: 268634 - DNA, 747 bp, Homo sapiens
  misc_feature: GYAE6OF02IQL9V.28.57.F02.1.454.CMB.1.raw
  modified_base (172)..(172): a, c, t, g, unknown or other
  misc_feature (172)..(172): n is a, c, g, or t
  modified_base (288)..(288): a, c, t, g, unknown or other
  misc_feature (288)..(288): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagcgtggtttctgttagctattttaaaggngtccagtgtgagtgcagctggtggagtcgtgggggagcgttggtccagccgtggggggtccctgagacctctccgtgtgcagcctcgtggacttccaaccttcaagttattttagngtctaagtgacgtaagtccggggtcccgtaccgacgggtcctacccggaagggggaacggacgttagggaattaacggtgttaccgtacggtaagggttatttaaaggaaaggttaagacggtaaccgaaaattaacaagtttaactaatttacgtaacgaactaaaacgttcttagggtacggaaacggtcgtaggtaatttccaaacccgttacttaccgaaccggtaagggtaaacctaaacgttaacccgaaaagtaaccgacgttacgttagtaaccttaacgttaacgaacgttggacctcggtaccgtagtacggacgtgtacggtaaggcgtaaccggtacgtttaagtacgtttagtacggttaagggggtacgaaggggtacgggaacggtaagggttaaccgtgggtaaccgggttaggggtttacgggtacggggacggtaacgggg

SEQ ID NO: 268635 - DNA, 688 bp, Homo sapiens
  misc_feature: GYAE6OF02FPEQS.28.57.F02.1.454.CMB.1.raw
  modified_base (548)..(548): a, c, t, g, unknown or other
  misc_feature (548)..(548): n is a, c, g, or t
  modified_base (586)..(586): a, c, t, g, unknown or other
  misc_feature (586)..(586): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctattttaaggtgtccagtgtgaggtgcagctggtggagtcgtgggggagcttggtccagccgtggggggtccctggagtactctcgtgtgcacgtcctcgtaggcttccaccttcagttattttagtgtcttagtcgtctacggtccgggtcccgtcccgagggtcccgtaccggaaggggaacggtacgtagggaattagtcgttactacggtaggttaacgttaaggtaaagtaacgtgaacgtaaacttaaacaagtttaatatttaagtacgtaaacctaaacgttcgttaggtaacgggtaaagggaccttaaggtactttacccgaacgttaacgtacccgtacgaacggaaccttaactaaccgaaagaccgtacgttntaggttaccttataacgacggtgaccgacgcgtaggancgtagcgaacggcgagtcgtatagtagttggagggttagggaaggaacggtaggaggttaacgttacgggtaacggtttggggtacggcgggggagtacggg

SEQ ID NO: 268636 - DNA, 714 bp, Homo sapiens
  misc_feature: GYAE6OF02GCBMG.28.57.F02.1.454.CMB.1.raw
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcgttggtccagccgtggggggtccctgagactctcctgtgcacgcctcgtggattcaccttcagttatttatgctatgctacgtgggtcccgccgaggcctaccgaggggaagggacgtaggaatatggtctcgtaggttattaagaagtaagtgacgtaaataactaattaattattaagtagactaaactcgtagtaggaagggtcaagtacttacaacctactaccgtacccgaagggtaacctaacgttaacccaaacgtaaaccgacggtaccttacgttaacttaccttaacgtaaacggttcggggacctacgggtacccgttaggaaggtacggtacgttacgggaacgggttaccggaaccgggtcgttacgttacgttaacggtttacggtggggttaaggggacgggtaaggggtaacggtacgggtaaagtttacgggggtaaaccggttagggggtttaggggtccgggggtaccggtaaccggggg

SEQ ID NO: 268637 - DNA, 747 bp, Homo sapiens
  misc_feature: GYAE6OF02GRD0Q.28.57.F02.1.454.CMB.1.raw
  modified_base (301)..(301): a, c, t, g, unknown or other
  misc_feature (301)..(301): n is a, c, g, or t
tcagagtacgctatcacgaccggtgctcgatttagctcgatatagttgggtctgggagaggagcccccgccctgggtttccccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtactttatgctatgcactgggtccncaggctccgagggaaggctaggaatatgtctctaggtattagaagtaatgacgaataacatatattatagactaaactctgtaggaagggcaagtattccgaactacttacctaccgaagggtaacctaaacgttacccgaaaacggtaaaccaaccggtaccttaggttaaccttaccgtttaaaccgaaaacggtttcggggaacctaacgggtacccgttaggggaaacgtaaccggttaccggagggtaaaccgggaaacccgtaccggggttaacgtttacgggtttaacgtttaacggttttaacccggttggggttaaggggggtaaaccggaacgggggttaaaccggtacggggttaaaacggtttacgggggttaaaccgggtttacggggggttttacggggtaccgggggggtaacccggtaaacccggggggg

SEQ ID NO: 268638 - DNA, 796 bp, Homo sapiens
  misc_feature: GYAE6OF02H41F6.28.57.F02.1.454.CMB.1.raw
  modified_base (324)..(324): a, c, t, g, unknown or other
  misc_feature (324)..(324): n is a, c, g, or t
tcagagtacgctatcacgaccggtgctcgatttagctcgatatagttgggtctgggagaggagccccccgccctgggtttcccaggtgttctcatttggtgatcagcactgcacacagaagagtcatgacggagtttgggctgagctgggtttttccttgttgcttatttttaaaggtgtccagtgtgaggtgcagctggtggagtcgtgggggaggcttggtccagccgtcgggggtccctggagactcctcctgtgcacgcctcgtggtattcctacctttcgaagttattttatcgtactatgccacgttcggggtacccnccgacggtccttaccggaaggggaaacgggtaccgtaagggtaaacttaacgttggttaccgttacgtaagggttaaacgttaaggtaaaagttaaatacggtaaccgtaaaataaactaacttaaatttaactttaagtacgtaactaaaaccgtttcgttaggttaacggaaaggggtacccgaaggtaacgttaccaacccttaacgtaccgtacccgtaagggtaacctaaacgttacccgaaacgtaacccgtagtacttagttaacttacttaacgtaaaggtccggaccggtagtacccgtaggaacggtagacggttaaggaaccgggacgtacggtacgttaaggttacttaacggtttacgtaaggggtacgggttaaaggggagggtaacgggtaaccgggttaaggttacgggtaaaccgggtttacgggggttagggtacggggaccgggtaacggggg

SEQ ID NO: 268639 - DNA, 948 bp, Homo sapiens
  misc_feature: GYAE6OF02G3UIF.28.57.F02.1.454.CMB.1.raw
  modified_base (197)..(197): a, c, t, g, unknown or other
  misc_feature (197)..(197): n is a, c, g, or t
tcagagtacgctatcacgaccggtgctcgatttagctcgatatagttgggtctgggagaggacgcccccgccctgggtttcccaggtgttctcatttggtgatcagcactgcacacagaagagtcatgacggagtttgggctgagcttgggttttccttgttgtcttatttttaaaggtcgtcctagtgtgtaggtncgagcgtggtggaggtcggtggggggaggtcgttcggtccgacggtcccggtcggggggtccctggacgtacctccgttccgtggtcgacgtacgtccgtcgtggtacttccgaccctttcgaacgtttattttagtcggtaccttagtcggtacccgtaacgggtttccggggtaccccgtacccggtaggggtaccccgttacccggggaaaacgggggtaaccgggtaccggtaagggtaaacgttacgttccgggttaccgtagttaaagggttaaggtttaacgggtaaaacggttaacgttaacggaaacccgttaaaaacgtttaaaaccgtaacgttttaaacgtttaaagtttaaacggtacggttaaacccttaaaccggtttacggttaagggtaaacggggtaaccgggtaacgtaacgttaaccgttacccgtaaaccgttaccgttaacccggtaacccggttaaagggtaaaccccttaaaccgtttaaacccggaaaccggtaaacccgtaaccgtttaccggttaacgttaaccttaaccggttaaacgtaacgggtacggtacgtaccggttacgtacggaacggttacgacggttcggaaaccggtcggtaaccggtacgttacgtaattacggttacgtggggtaacggtagggaacgggtaacgtacgggttaacggtttacgggtaaacgggttacgggtttaacggggtccggtaccgggtaaccggg

SEQ ID NO: 268640 - DNA, 780 bp, Homo sapiens
  misc_feature: GYAE6OF02I0UH8.28.57.F02.1.454.CMB.1.raw
  modified_base (287)..(287): a, c, t, g, unknown or other
  misc_feature (287)..(287): n is a, c, g, or t
tcagagtacgctatcacgaccggtgctcgatttagctcgatatagttgggtctgggagaggagcccccgccctggtttcccaggtgttctcatttggtgatcagcactgcacacagaagagtcatgacggagttgggctgagctgggtttcctgttgctattttaaagtgtccagtgtgagtgcagctggtgagtcgtggggagcttggtcagccgtgggggtccctgagactctccgtgtcgcagcctcgtggtacttcaccgttctagtactttagcgtacttanggtccacgtcgggtacccgcgacgggtcctacccggaaggggaacggtaccgtaggaacgtagtcgtacgttaccgtaagggttaattaaaggaacgtttaagacggtaaccggtaaattaaacgtaattaagttaaagtttacgtacgtaaccgttaaacgtacgttacggttaacggaacgggtacccggtaagtaaccgtttccaaaccgttaacgttccggtaacccggaacgggttaaccaaccgtttaacccgaaggtaaaccgtaccggttcgtaacggtttacttaccgttaaacgaaacggttcgggaacccgtagtacccggtagaacgtaacccgttgtaccggacggaaccgttccgggtaacgttacgtacgtttaacttacgggtcgggttaacgggtacgtaacgggacggttacccgggtaagttaaccggggaacggtttacgggggttacgtacccgggggtaagtacccggggg

SEQ ID NO: 268641 - DNA, 581 bp, Homo sapiens
  misc_feature: GYAE6OF02GTC5G.28.57.F02.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
  modified_base (487)..(487): a, c, t, g, unknown or other
  misc_feature (487)..(487): n is a, c, g, or t
  modified_base (567)..(567): a, c, t, g, unknown or other
  misc_feature (567)..(567): n is a, c, g, or t
tcagagtacgctatcacgaccggtgctcgatttagctcgatatagttgggtctgggagaggagcccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggtcttggtccagccgtggggggtccctgagactctcctgtgcagcctctggacttcaccttnagttatttatgctatgcacgtcgggtcccgccnggcctccggaagggagggactaggaatagtgtctacgtaggtattagaagttagngacgtaaataanaattattattatgactaactctagtagaggcagtatcactntcaccgaggactaactccaagaacaccgtnttacgtaacttctactaaggtcgactgacgtagagacgcgngaacgccgagcgttatacgttattcggtggtagggacgtaggacggtaacggtaagttagggaccgttaggggttcgggnggggacctacgggg

SEQ ID NO: 268642 - DNA, 631 bp, Homo sapiens
  misc_feature: GYAE6OF02I2IY4.28.57.F02.1.454.CMB.1.raw
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (309)..(309): a, c, t, g, unknown or other
  misc_feature (309)..(309): n is a, c, g, or t
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
tcagagtacgctatcacgaccggtgctcgatttagctcgatatagttgggtcgtgggagaggagcccccgccctcgggtttcccacggtgttctcatttggtgatcagcactgcacacagaagagtcatgacggagtttgggctgagctggtttccttgttgctatttttaaaggtgtccagtgtgaggtgcagctggtggagtcgtgggggaggctggtccagccgtgggggtcctgagactcgtcctggtgacgagcctntggacttctaccttcagttatttancgctagtgctacgtgggtcccnccagggcttccgaagggacggactaggaactagtcgtcctacgaggttaattagtaacgttagtcgtaacgtaaacttacaattaagtttaattagttacgaactaatccgtagtaggaaggcaacgtataccacgtatctacggacgatactaccgaaacgaacncgtactagttactaccttanaagtcgacgtgcagngacgtgagtacggacgacggtactacgttataagttaccggtaggtaagggagtaacgggtaagacggttacggttaacgggtaaccggttaggggttacgggtcgggacgggtaaccggg
